US008399226B2

(12) United States Patent
Hong et al.

(10) Patent No.: US 8,399,226 B2
(45) Date of Patent: Mar. 19, 2013

(54) HIGH EICOSAPENTAENOIC ACID OILS FROM IMPROVED OPTIMIZED STRAINS OF YARROWIA LIPOLYTICA

(75) Inventors: Seung-Pyo Hong, Hockessin, DE (US); Pamela L. Sharpe, Wilmington, DE (US); Zhixiong Xue, Chadds Ford, PA (US); Narendra S. Yadav, Wilmington, DE (US); Quinn Qun Zhu, West Chester, PA (US)

(73) Assignee: E I du Pont de Nemours and Company, Wilmington, DE (US)

( * ) Notice: Subject to any disclaimer, the term of this patent is extended or adjusted under 35 U.S.C. 154(b) by 353 days.

(21) Appl. No.: 12/814,880

(22) Filed: Jun. 14, 2010

(65) Prior Publication Data

US 2010/0317735 A1   Dec. 16, 2010

Related U.S. Application Data

(60) Provisional application No. 61/187,368, filed on Jun. 16, 2009.

(51) Int. Cl.
 *C12P 7/64* (2006.01)
 *A23D 9/00* (2006.01)

(52) U.S. Cl. .................. 435/134; 435/243; 435/254.21; 435/255.1; 554/224; 554/175; 554/206; 554/207; 426/442; 426/635

(58) Field of Classification Search ................ None
 See application file for complete search history.

(56) References Cited

U.S. PATENT DOCUMENTS

| | | | |
|---|---|---|---|
| 5,665,667 A | 9/1997 | Lemanski et al. | |
| 6,166,230 A | 12/2000 | Bijl et al. | |
| 6,255,505 B1 | 7/2001 | Bijl et al. | |
| 7,709,236 B2 | 5/2010 | Akimoto et al. | |
| 2006/0110806 A1 | 5/2006 | Damude et al. | |
| 2006/0115881 A1 | 6/2006 | Damude et al. | |
| 2008/0254191 A1 | 10/2008 | Damude et al. | |
| 2009/0093543 A1 | 4/2009 | Xue et al. | |
| 2009/0285969 A1 | 11/2009 | Schaap et al. | |
| 2009/0325265 A1 | 12/2009 | Damude et al. | |
| 2010/0159558 A1 | 6/2010 | Zhu et al. | |

FOREIGN PATENT DOCUMENTS

| | | |
|---|---|---|
| EP | 0862369 B1 | 3/2001 |
| WO | 2006085144 A2 | 8/2006 |
| WO | 2008004900 A1 | 1/2008 |

(Continued)

OTHER PUBLICATIONS

Grima, E.M., et al., Gram-scale purificatin of eicosapentaenoc acid (EPA, 20:5n-3) from wet *Phaeodactylum tricornutum* UETEX biomass, 1996, Journal of Applied Phycology, vol. 8, pp. 359-367.*

(Continued)

*Primary Examiner* — Yate K Cutliff

(57) ABSTRACT

Described are engineered strains of the oleaginous yeast *Yarrowia lipolytica* capable of producing an oil comprising greater than 50 weight percent of eicosapentaenoic acid ["EPA"], an ω-3 polyunsaturated fatty acid, measured as a weight percent of total fatty acids ["% TFAs"] and having a ratio of at least 3.1 of EPA % TFAs, to linoleic acid, measured as % TFAs. These strains over-express at least one Δ9 elongase/Δ8 desaturase multizyme, in addition to other heterologous Δ9 elongases, Δ8 desaturases, Δ5 desaturases, Δ17 desaturases, Δ12 desaturases, $C_{16/18}$ elongases, and optionally over-express diacylglycerol cholinephosphotransferases, malonyl CoA synthetases and/or acyl-CoA lysophospholipid acyltransferases. The strains possess at least one peroxisome biogenesis factor protein knockout. Methods for producing EPA within said host cells, oils obtained from the cells, and products therefrom are claimed.

23 Claims, 15 Drawing Sheets

FOREIGN PATENT DOCUMENTS

Figure 1A:
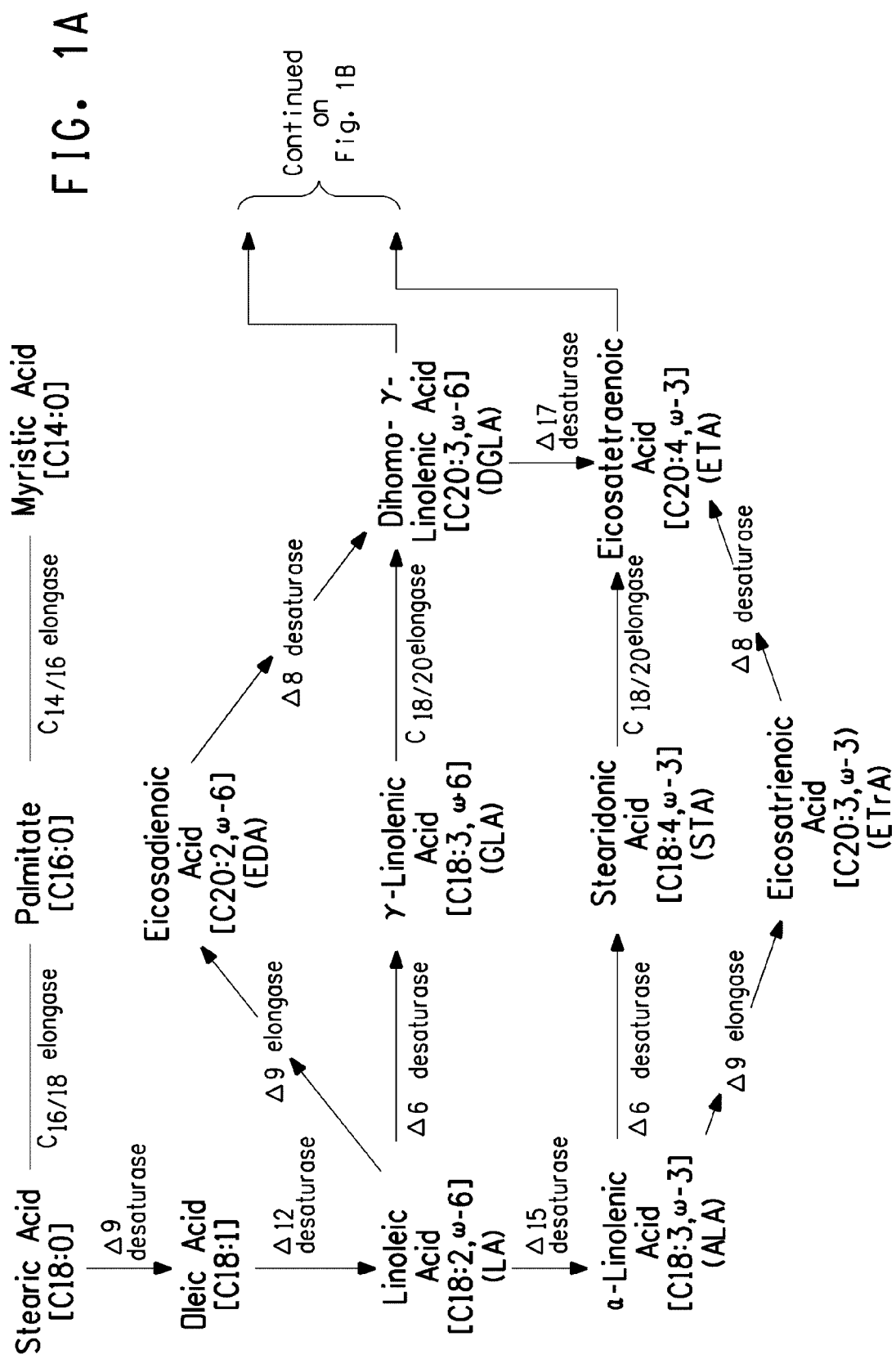

| | | |
|---|---|---|
| WO | 2008088415 A8 | 7/2008 |
| WO | 2010080388 A1 | 7/2010 |

OTHER PUBLICATIONS

International Search Report, PCT International Application PCT/US2010/038539, Mailed Dec. 1, 2010.

M. J. I. Gonzalez et al., Adsorption Equilibria of Fatty Acids Between Methanol/Water and Reversed-Phase Chromatographic Adsorbents, Journal of the American Oil Chemists' Society, vol. 78, No. 3 (2001), p. 277-285.

A. R. Medina et al., Lipase-Catalyzed Esterification of Glycerol and Polyunsaturated Fatty Acids From Fish and Microalgae Oils, Journal of Biotechnology, vol. 70 (1999), pp. 379-391.

A. R. Medina et al., Concentration and Purification of Stearidonic, Eicosapentaenoic and Docosahexaenoic Acids From Cod Liver Oil and the Marine Microalga Isochrysis Galbana, Journal of the American Oil Chemists' Society, vol. 72, No. 5 (1995), pp. 575-583.

Yokoyama et al., Effects of Eicosapentaenoic Acid on the Cardiovascular Events in Japanese Patients With Hypercholesterolemia: Rationale, Design and Baseline Characteristics of the Japan EPA Lipid Intervention Study (JELIS), American Heart Journal, vol. 146, No. 4 (2003), pp. 613-620.

Jareonkitmongkol et al., Production of an Eicosapentaenoic Acid-Containing Oil by a Delta-12 Desaturase-Defective Mutant of Mortierella Alpina 1S-4, JAOCS, vol. 70, No. 2 (1993), pp. 119-123.

Saito et al., Effects of EPA on Coronary Artery Disase in Hypercholesterolemic Patients With Multiple Risk Factors: Sub-Analysis of Primary Prevention Cases From the Japan EPA Lipid Intervention Study (JELIS), Atherosclerosis, vol. 200 (2008), pp. 135-140.

Sakaki et al., Supercritical Fluid Extraction of Fungal Oil Using $CO_2$, $N_2O$, CHFC and $SF_6$, JAOCS, vol. 67, No. 9 (1990), pp. 553-557.

\* cited by examiner

| Strain | LA % TFAs | EPA % TFAs | Ratio EPA/LA |
|---|---|---|---|
| Y8404 | 20.40 | 51.10 | 2.50 |
| Y8405 | 20.50 | 51.40 | 2.51 |
| Y8406 | 20.30 | 51.20 | 2.52 |
| Y8407 | 20.50 | 51.50 | 2.51 |
| Y8408 | 20.20 | 51.20 | 2.53 |
| Y8409 | 20.60 | 51.00 | 2.48 |
| Y8410 | 20.50 | 50.90 | 2.48 |
| Y8411 | 19.90 | 52.90 | 2.66 |
| Y8412 | 19.00 | 55.80 | 2.94 |
| Y8413 | 19.90 | 52.40 | 2.63 |
| Y8414 | 19.90 | 49.40 | 2.48 |
| Y8415 | 16.00 | 59.00 | 3.69 |
| Y8647 | 20.30 | 53.60 | 2.64 |
| Y8648 | 18.60 | 56.70 | 3.05 |
| Y8649 | 18.80 | 55.80 | 2.97 |
| Y8650 | 18.80 | 56.10 | 2.98 |
| Y9028 | 19.80 | 54.50 | 2.75 |
| Y9029 | 19.80 | 53.80 | 2.72 |
| Y9031 | 20.10 | 52.30 | 2.60 |
| Y9477 | 10.00 | 61.40 | 6.14 |

| Strain | LA % TFAs | EPA % TFAs | Ratio EPA/LA |
|---|---|---|---|
| Y9481 | 11.00 | 60.90 | 5.54 |
| Y9486 | 11.90 | 60.30 | 5.07 |
| Y9497 | 11.30 | 58.70 | 5.19 |
| Y9502 | 12.70 | 57.00 | 4.49 |
| Y9504 | 11.30 | 59.90 | 5.30 |
| Y9508 | 13.10 | 58.70 | 4.48 |
| Y9510 | 11.70 | 58.90 | 5.03 |
| Y8143 | 18.10 | 50.30 | 2.78 |
| Y8144 | 18.00 | 50.60 | 2.81 |
| Y8145 | 18.60 | 48.50 | 2.61 |
| Y8146 | 18.70 | 48.30 | 2.58 |
| Y8256 | 18.80 | 49.90 | 2.65 |
| Y8259 | 16.90 | 53.90 | 3.19 |
| Y8367 | 14.20 | 58.30 | 4.11 |
| Y8368 | 17.90 | 52.50 | 2.93 |
| Y8369 | 15.60 | 55.80 | 3.58 |
| Y8370 | 15.70 | 56.40 | 3.59 |
| Y8666 | 15.10 | 62.20 | 4.12 |
| Y8669 | 15.70 | 61.50 | 3.92 |
| Y8670 | 17.00 | 60.90 | 3.58 |
| Y8672 | 16.10 | 61.80 | 3.84 |

FIG. 13

'HIGH EICOSAPENTAENOIC ACID OILS FROM IMPROVED OPTIMIZED STRAINS OF YARROWIA LIPOLYTICA

This application claims the benefit of U.S. Provisional Applications No. 61/187,366, No. 61/187,368 and No. 61/187,359, each filed Jun. 16, 2009 and each of which is hereby incorporated by reference in its entirety.

FIELD OF THE INVENTION

This invention is in the field of biotechnology. More specifically, this invention pertains to an engineered strain of the oleaginous yeast Yarrowia lipolytica that is capable of efficiently producing eicosapentaenoic acid, an ω-3 polyunsaturated fatty acid ["PUFA"], in high concentrations.

BACKGROUND OF THE INVENTION

The clinical and pharmaceutical value of eicosapentaenoic acid ["EPA"; cis-5, 8, 11, 14, 17-eicosapentaenoic acid; ω-3] are well known (U.S. Pat. Appl. Pub. No. 2009-0093543-A1). Similarly, the advantages of producing EPA in microbes using recombinant means, as opposed to producing EPA from natural microbial sources or via isolation from fish oil and marine plankton, are also well recognized.

Although the literature reports a number of recent examples whereby various portions of the ω-3/ω-6 polyunsaturated fatty acid ["PUFA"] biosynthetic pathway, responsible for EPA production, have been introduced into plants and non-oleaginous yeast, significant efforts by the Applicants' Assignee has focused on the use of the oleaginous yeast, Yarrowia lipolytica (U.S. Pat. No. 7,238,482; U.S. Pat. Appl. Pub. No. 2006-0115881-A1; U.S. Pat. Appl. Pub. No. 2009-0093543-A1). Oleaginous yeast are defined as those yeast that are naturally capable of oil synthesis and accumulation, wherein oil accumulation is at least 25% of the cellular dry weight.

More specifically, U.S. Pat. Appl. Pub. No. 2006-0115881-A1 demonstrated production of 9% EPA of total fatty acids in a recombinant Yarrowia lipolytica strain without co-synthesis of γ-linolenic acid ["GLA"; ω-6], by expression of the following genes: Δ9 elongase, Δ8 desaturase, Δ5 desaturase, Δ17 desaturase, Δ12 desaturase and $C_{16/18}$ elongase.

U.S. Pat. Appl. Pub. No. 2009-0093543-A1 describes optimized recombinant Yarrowia lipolytica strains for EPA production and demonstrated production of up to 55.6% EPA of total fatty acids in a recombinant Y. lipolytica strain by expression of the following genes: Δ9 elongase, Δ8 desaturase, Δ5 desaturase, Δ17 desaturase, Δ12 desaturase, $C_{16/18}$ elongase and diacylglycerol cholinephosphotransferase, within a host cell comprising a disruption in the native peroxisome biogenesis factor 10 protein (PEX10).

Despite the disclosures cited above, strain improvements are necessary for commercial production of EPA that will permit production of high EPA as a weight percent of the total fatty acids in addition to high total lipid content, while minimizing production of intermediate fatty acids, such as linoleic acid ["LA"; ω-6], and byproduct fatty acids in the final oil product. Applicants have solved the stated problem by engineering improved optimized strains of Yarrowia lipolytica, wherein the improvement enables at least one of the following: production of 61.8% EPA in the total oil fraction, production of 39.6% total fatty acids as a percent of the dry cell weight, or production of lipids having an EPA to LA ratio of 6.1.

SUMMARY OF THE INVENTION

In a first embodiment, the invention concerns an extracted oil comprising:
(a) at least 50 weight percent of eicosapentaenoic acid measured as a weight percent of total fatty acids; and,
(b) having a ratio of at least 3.1 of eicosapentaenoic acid, measured as a weight percent of total fatty acids, to linoleic acid, measured as a weight percent of total fatty acids.
Preferably, the oil is microbial.

In a second embodiment, the invention concerns an extracted oil of the invention wherein said oil is extracted from fermented recombinant Yarrowia sp. cells engineered for production of eicosapentaenoic acid, wherein said cells comprise:
a) at least at least one multizyme which comprises a polypeptide having at least one Δ9 elongase linked to at least one Δ8 desaturase;
(b) at least one peroxisome biogenesis factor protein whose expression has been down-regulated; and,
(c) at least one recombinant construct comprising a nucleotide sequence encoding an enzyme selected from the group consisting of malonyl CoA synthetase and acyl-CoA lysophospholipid acyltransferase.

Preferably, the malonyl CoA synthetase consists essentially of a sequence selected from the group consisting of SEQ ID NO:40 and SEQ ID NO:42.

Preferably, the acyl-CoA lysophospholipid acyltransferase consists essentially of a sequence selected from the group consisting of SEQ ID NO:15, SEQ ID NO:17, SEQ ID NO:25, SEQ ID NO:29, SEQ ID NO:31 and SEQ ID NO:32.

Preferably, the multizyme linker is selected from the group consisting of: SEQ ID NO:1, SEQ ID NO:2, SEQ ID NO:3, SEQ ID NO:4, SEQ ID NO:5, SEQ ID NO:6 and SEQ ID NO:7.

Preferably, the multizyme consists essentially of a sequence selected from the group consisting of: SEQ ID NO:9, SEQ ID NO:11 and SEQ ID NO:13.

In a third embodiment, the invention concerns a blended oil comprising the oil of any of claims 1-6 or a derivative thereof.

The blended oil of the invention can also comprise an additional quantity of a fatty acid selected from the group consisting of: linoleic acid, γ-linolenic, eicosadienoic acid, dihomo-γ-linolenic acid, arachidonic acid, docosatetraenoic acid, ω-6 docosapentaenoic acid, α-linolenic acid, stearidonic acid, eicosatrienoic acid, eicosatetraenoic acid, ω-3 docosapentaenoic acid and docosahexaenoic acid.

In a fourth embodiment, the invention concerns food or feed comprising the oil of the invention or a derivative thereof or a blend of the oil or derivative thereof.

In a fifth embodiment, the invention concerns food of the invention wherein said food is selected from the group consisting of a food analog, a functional food, a medical food and a medical nutritional.

In a sixth embodiment, the invention concerns a product comprising the oil of the invention or a derivative thereof or a blend of the oil or derivative thereof, wherein said product is selected from the group consisting of a pharmaceutical product, infant formula, dietary supplement, and animal feed.

In a seventh embodiment, the invention concerns a microbial biomass comprising the oil of the invention.

In an eighth embodiment, the invention concerns animal feed comprising the microbial biomass of the invention.

In a ninth embodiment, the invention concerns animal feed of the invention wherein the feed is an aquaculture feed.

In a tenth embodiment, the invention concerns oil of the invention wherein said oil is extracted from a recombinant

*Yarrowia* sp. host cell using a process selected from the group consisting of: extraction with organic solvents, sonication and supercritical fluid extraction.

Biological Deposits

The following biological materials have been deposited with the American Type Culture Collection (ATCC), 10801 University Boulevard, Manassas, Va. 20110-2209, and bear the following designations, accession numbers and dates of deposit.

| Biological Material | Accession No. | Date of Deposit |
|---|---|---|
| *Yarrowia lipolytica* Y8406 | ATCC PTA-10025 | May 14, 2009 |
| *Yarrowia lipolytica* Y8412 | ATCC PTA-10026 | May 14, 2009 |
| *Yarrowia lipolytica* Y8259 | ATCC PTA-10027 | May 14, 2009 |

The biological materials listed above were deposited under the terms of the Budapest Treaty on the International Recognition of the Deposit of Microorganisms for the Purposes of Patent Procedure. The listed deposit will be maintained in the indicated international depository for at least 30 years and will be made available to the public upon the grant of a patent disclosing it. The availability of a deposit does not constitute a license to practice the subject invention in derogation of patent rights granted by government action.

BRIEF DESCRIPTION OF THE DRAWINGS AND SEQUENCE DESCRIPTIONS

Figure 1B:
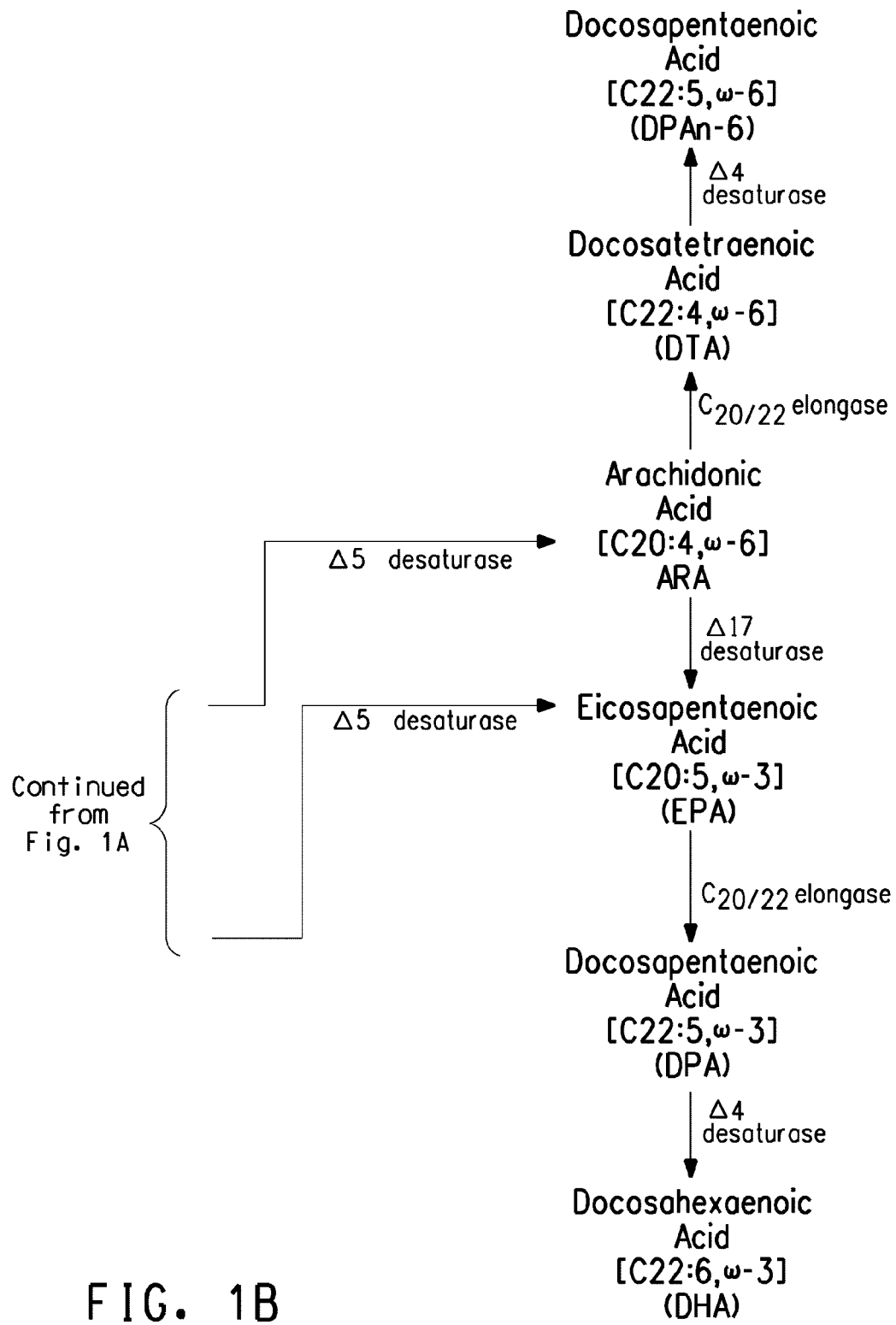

FIG. 1A and FIG. 1B illustrate the ω-3/ω-6 fatty acid biosynthetic pathway, and should be viewed together when considering the description of this pathway below.

Figure 2:
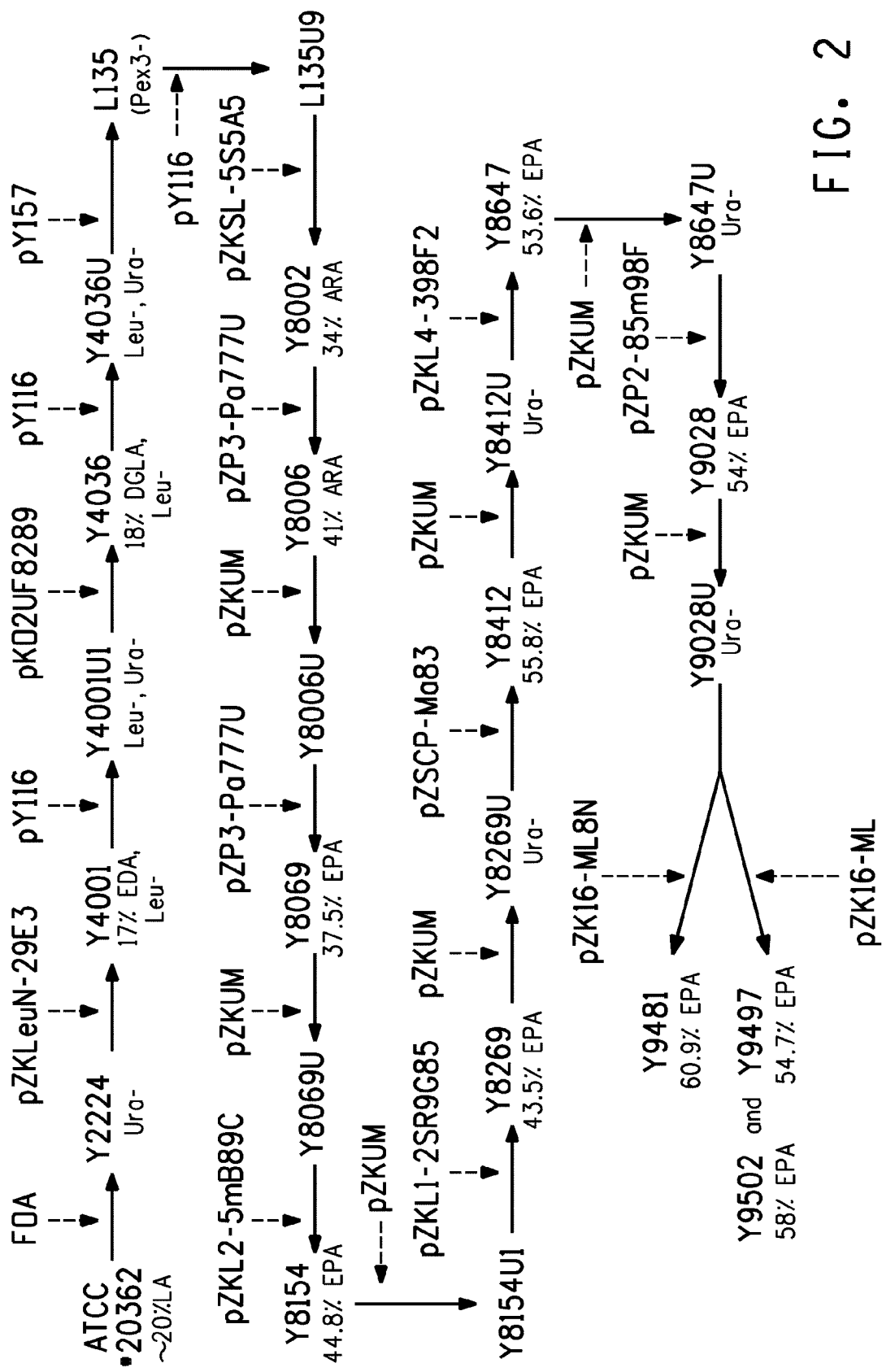

FIG. 2 diagrams the development of *Yarrowia lipolytica* strains Y9481, Y9497 and Y9502, producing greater than 60.9% EPA in the total lipid fraction.

Figure 3:
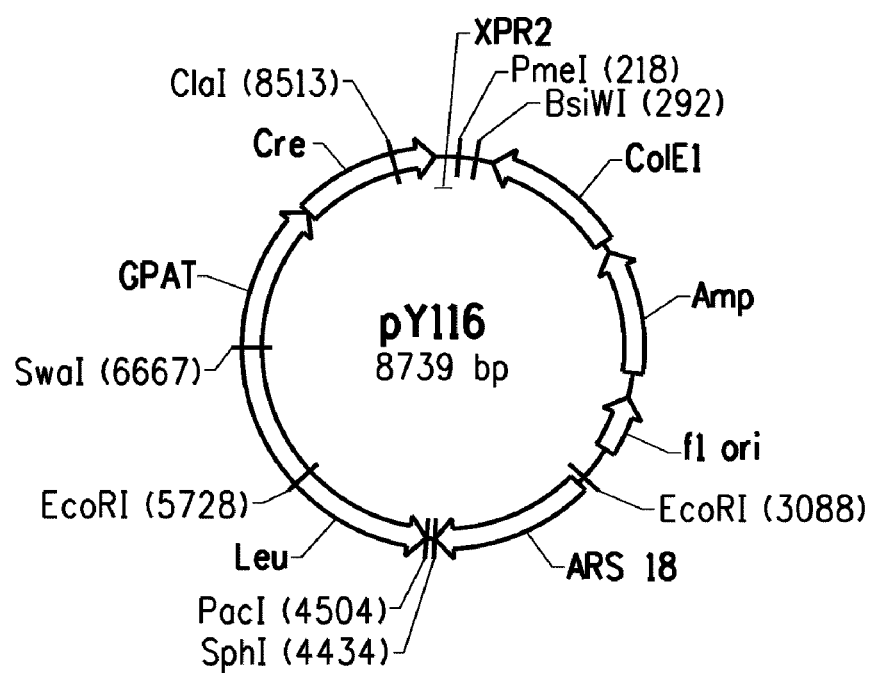

FIG. 3 provides a plasmid map for pY116.

FIG. 4 provides plasmid maps for the following: (A) pZKSL-555A5; and, (B) pZP3-Pa777U.

FIG. 5 provides plasmid maps for the following: (A) pZKUM; and, (B) pZKL2-5mB89C.

FIG. 6 provides plasmid maps for the following: (A) pZKL1-2SR9G85; and, (B) pZSCP-Ma83.

FIG. 7 provides plasmid maps for the following: (A) pZKL4-398F2; and, (B) pZP2-85 m98F.

FIG. 8 provides plasmid maps for the following: (A) pZK16-ML8N; and, (B) pZK16-ML.

Figure 9:
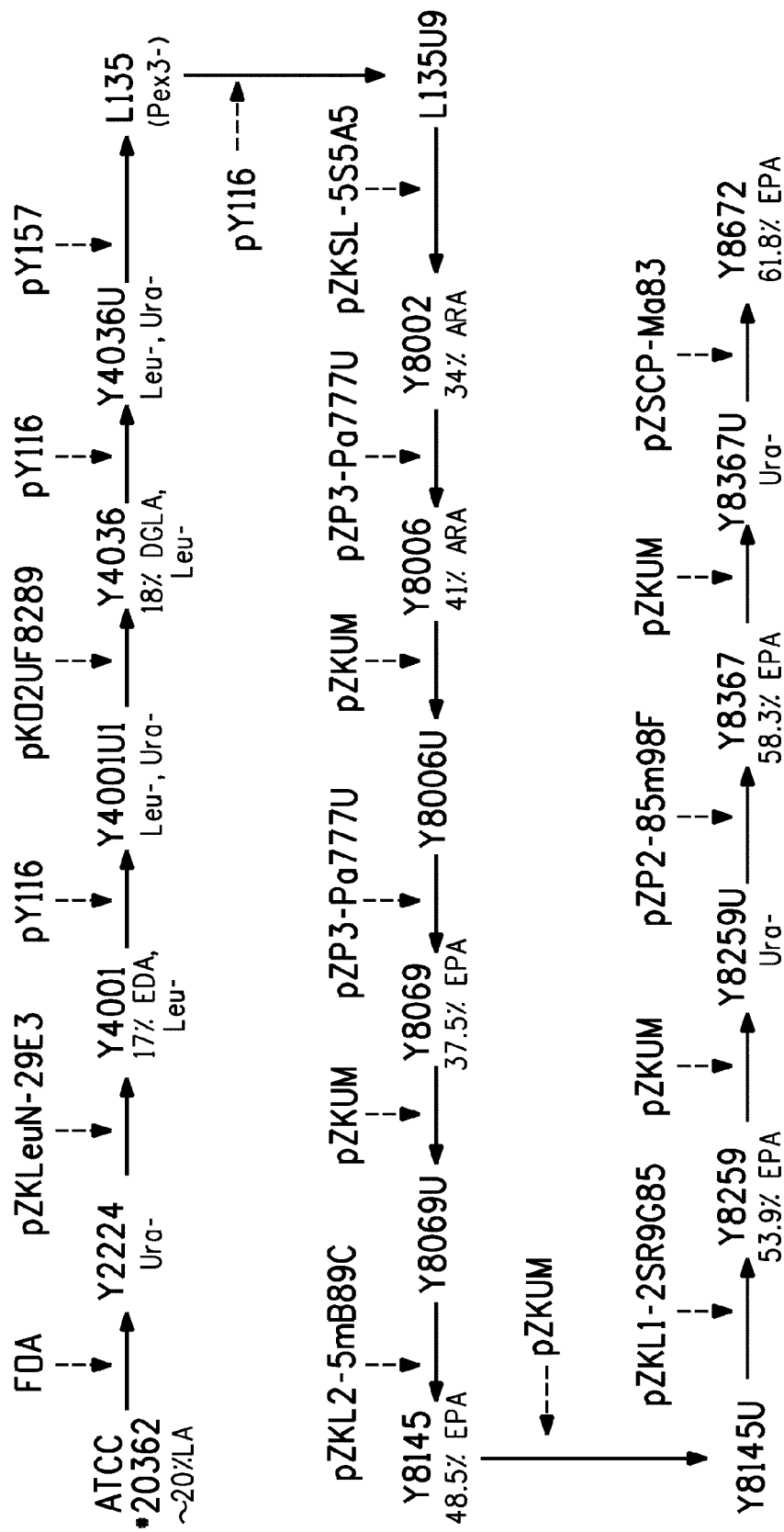

FIG. 9 diagrams the development of *Yarrowia lipolytica* strain Y8672, producing greater than 61.8% EPA in the total lipid fraction.

FIG. 10 provides plasmid maps for the following: (A) pZKL2-5m89C; and, (B) pY201, comprising a chimeric YAT1::ScAle1S::Lip1 gene.

Figure 11A:
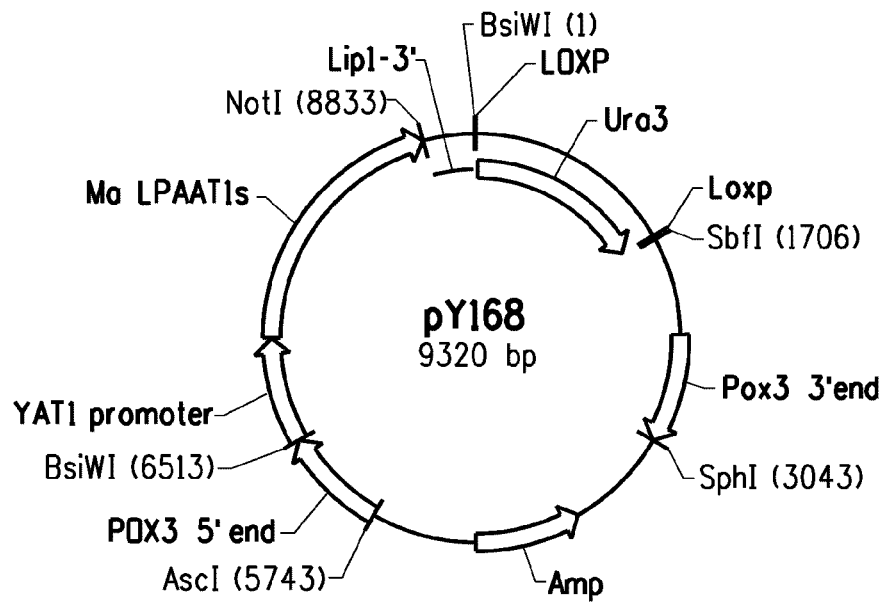
Figure 11B:
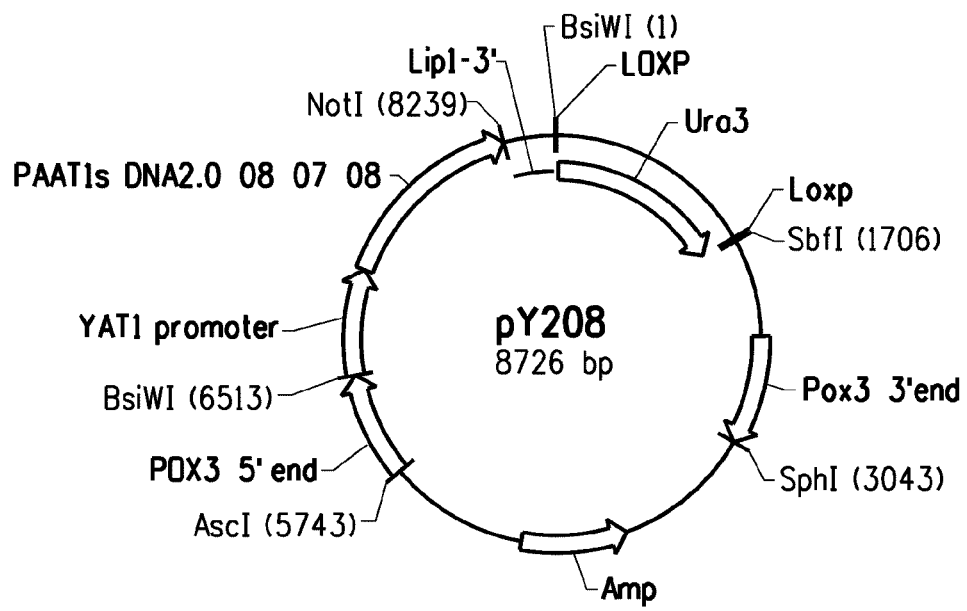

FIG. 11 provides plasmid maps for the following: (A) pY168, comprising a chimeric YAT1::YlAle1::Lip1 gene; and, (B) pY208, comprising a chimeric YAT1::MaLPAAT1S::Lip1 gene.

Figure 12A:
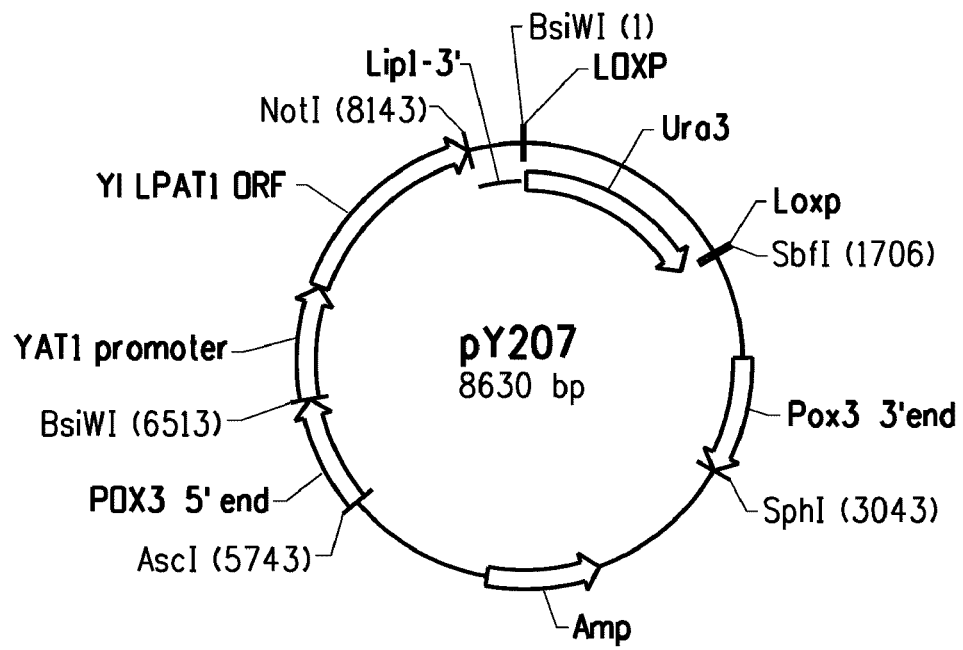
Figure 12B:
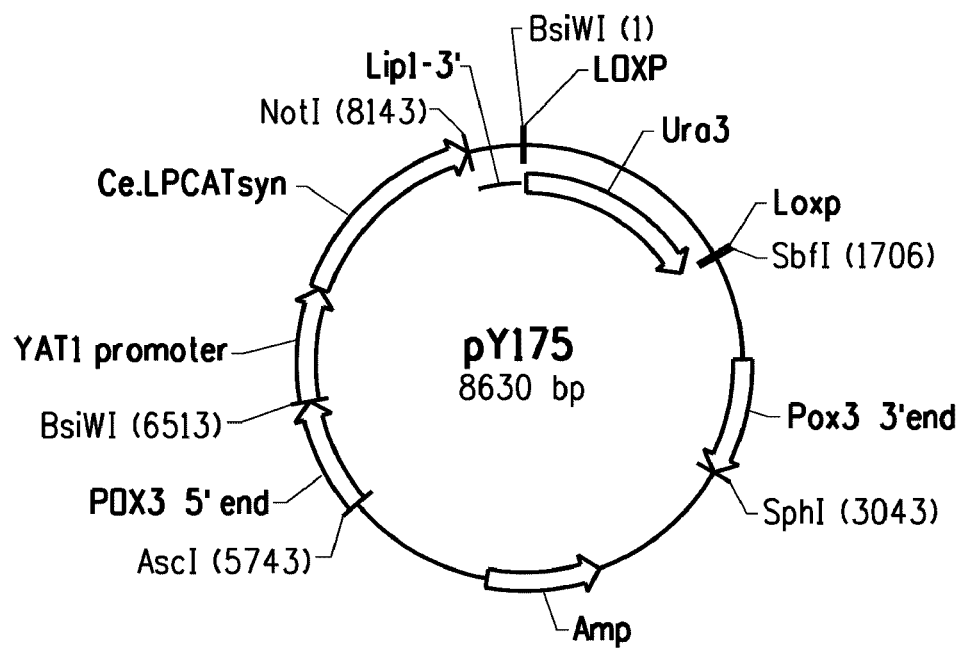

FIG. 12 provides plasmid maps for the following: (A) pY207, comprising a chimeric YAT1::YlLPAAT1::Lip1 gene; and, (B) pY175, comprising a chimeric YAT1::CeLPCATS::Lip1 gene.

FIG. 13 provides a comparison of EPA % TFAs, LA % TFAs and the ratio of EPA % TFAs to LA % TFAs in each of the strains described in the Examples.

FIG. 14 provides plasmid maps for the following: (A) pY222, comprising a chimeric YAT1::ScLPAATS::Lip1 gene; and, (B) pY177, comprising a chimeric YAT1::YlLPAAT1::Lip1 gene.

The invention can be more fully understood from the following detailed description and the accompanying sequence descriptions, which form a part of this application.

The following sequences comply with 37 C.F.R. §1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37C.F.R. §1.822.

SEQ ID NOs:1-156 are ORFs encoding promoters, genes or proteins (or fragments thereof) or plasmids, as identified in Table 1.

TABLE 1

Summary of Gene and Protein SEQ ID Numbers

| Description | Nucleic acid SEQ ID NO. | Protein SEQ ID NO. |
|---|---|---|
| Multizyme linker GAGPARPAGLPPATYYDSLAVMGS | — | 1 |
| Multizyme linker GPARPAGLPPATYYDSLAV | — | 2 |
| Multizyme linker PARPAGLPPATYYDSLAV | — | 3 |
| Multizyme linker PTRPAGPPPATYYDSLAV | — | 4 |
| Multizyme linker PGGPGKPSEIASLPPPIRPVGNPPAAYYDALAT | — | 5 |
| Multizyme linker PARPAGLPPATYYDSLAVSGRT | — | 6 |
| Multizyme linker PGGPGKPSEIASLPPPIRPVGNPPAAYYDALATGRT | — | 7 |
| DGLA synthase, comprising EgD9eS/EgD8M gene fusion | 8 (2112 bp) | 9 (703 AA) |
| DGLA synthase, comprising EaD9eS/EaD8S gene | 10 | 11 |

TABLE 1-continued

Summary of Gene and Protein SEQ ID Numbers

| Description | Nucleic acid SEQ ID NO. | Protein SEQ ID NO. |
|---|---|---|
| fusion | (2109 bp) | (702 AA) |
| DGLA synthase, comprising E389D9eS/EgD8M gene fusion | 12 (2127 bp) | 13 (708 AA) |
| *Saccharomyces cerevisiae* Ale1 ("ScAle1"; also ORF "YOR175C") | 14 (1860 bp) | 15 (619 AA) |
| *Yarrowia lipolytica* Ale1 ("YlAle1") | 16 (1539 bp) | 17 (512 AA) |
| membrane bound O-acyltransferase motif M(V/I)LxxKL | — | 18 |
| membrane bound O-acyltransferase motif RxKYYxxW | — | 19 |
| membrane bound O-acyltransferase motif SAxWHG | — | 20 |
| U.S. Pat. Appl. Pub. No. 2008-0145867-A1 motif $EX_{11}WNX_2-[T/V]-X_2W$ | — | 21 |
| Synthetic Ale1 derived from *Saccharomyces cerevisiae*, codon-optimized for expression in *Yarrowia lipolytica* ("ScAle1S") | 22 (1870 bp) | 23 (619 AA) |
| *Caenorhabditis elegans* LPCAT ("CeLPCAT") | 24 (849 bp) | 25 (282 AA) |
| Synthetic LPCAT derived from *Caenorhabditis elegans*, codon-optimized for expression in *Yarrowia lipolytica* ("CeLPCATS") | 26 (859 bp) | 27 (282 AA) |
| *Mortierella alpina* LPAAT1 ("MaLPAAT1") | 28 (945 bp) | 29 (314 AA) |
| *Yarrowia lipolytica* LPAAT1 ("YlLPAAT1") | 30 (1549 bp) | 31 (282 AA) |
| *Saccharomyces cerevisiae* LPAAT ("ScLPAAT"; also ORF "YDL052C") | — | 32 (303 AA) |
| 1-acyl-sn-glycerol-3-phosphate acyltransferase motif NHxxxxD | — | 33 |
| 1-acyl-sn-glycerol-3-phosphate acyltransferase motif EGTR | — | 34 |
| Synthetic LPAAT1 derived from *Mortierella alpina*, codon-optimized for expression in *Yarrowia lipolytica* ("MaLPAAT1S") | 35 (955 bp) | 36 (314 AA) |
| *Yarrowia lipolytica* diacylglycerol cholinephosphotransferase gene ("YlCPT1") | 37 (1185 bp) | 38 (394 AA) |
| *Rhizobium leguminosarum* bv. *viciae* 3841 malonyl-CoA synthetase (GenBank Accession No. YP_766603) ("rMCS") | 39 (1515 bp) | 40 (504 AA) |
| Synthetic malonyl-CoA synthetase derived from *Rhizobium leguminosarum* bv. *viciae* 3841 (GenBank Accession No. YP_766603), codon-optimized for expression in *Yarrowia lipolytica* ("MCS") | 41 (1518 bp) | 42 (505 AA) |
| *Euglena gracilis* Δ9 elongase ("EgD9e") | 43 (777 bp) | 44 (258 AA) |
| Synthetic Δ9 elongase derived from *Euglena gracilis*, codon-optimized for expression in *Yarrowia lipolytica* ("EgD9eS") | 45 (777 bp) | 46 (258 AA) |
| *Eutreptiella* sp. CCMP389 Δ9 elongase ("E389D9e") | 47 (792 bp) | 48 (263 AA) |
| Synthetic Δ9 elongase derived from *Eutreptiella* sp. | 49 | 50 |

TABLE 1-continued

Summary of Gene and Protein SEQ ID Numbers

| Description | Nucleic acid SEQ ID NO. | Protein SEQ ID NO. |
|---|---|---|
| CCMP389 codon-optimized for expression in *Yarrowia lipolytica* ("E389D9eS") | (792 bp) | (263 AA) |
| *Euglena anabaena* UTEX 373 Δ9 elongase ("EaD9Elo1") | 51 (774 bp) | 52 (258 AA) |
| Synthetic Δ9 elongase derived from *Euglena anabaena* UTEX 373, codon-optimized for expression in *Yarrowia lipolytica* ("EaD9eS") | 53 (774 bp) | 54 (258 AA) |
| *Euglena gracilis* Δ8 desaturase ("Eg5" or "EgD8") | 55 (1271 bp) | 56 (421 AA) |
| Synthetic Δ8 desaturase derived from *Euglena gracilis*, codon-optimized for expression in *Yarrowia lipolytica* ("D8SF" or "EgD8S") | 57 (1272 bp) | 58 (422 AA) |
| Synthetic mutant Δ8 desaturase ("EgD8M"), derived from *Euglena gracilis* ("EgD8S") | 59 (1272 bp) | 60 (422 AA) |
| *Euglena anabaena* UTEX 373 Δ8 desaturase ("EaD8es3") | 61 (1260 bp) | 62 (420 AA) |
| Synthetic Δ8 desaturase derived from *Euglena anabaena* UTEX 373, codon-optimized for expression in *Yarrowia lipolytica* ("EaD8S") | 63 (1260 bp) | 64 (420 AA) |
| *Euglena gracilis* Δ5 desaturase ("EgD5") | 65 (1350 bp) | 66 (449 AA) |
| Synthetic Δ5 desaturase derived from *Euglena gracilis*, codon-optimized for expression in *Yarrowia lipolytica* ("EgD5S") | 67 (1350 bp) | 68 (449 AA) |
| Mutant Δ5 desaturase ("EgD5M"), derived from *Euglena gracilis* ("EgD5") (U.S. Pat. Pub. No. 2010-0075386-A1) | 69 (1350 bp) | 70 (449 AA) |
| Synthetic mutant Δ5 desaturase ("EgD5SM"), derived from *Euglena gracilis* ("EgD5S") (U.S. Pat. Pub. No. 2010-0075386-A1) | 71 (1350 bp) | 72 (449 AA) |
| *Peridinium* sp. CCMP626 Δ5 desaturase ("RD5") | 73 (1392 bp) | 74 (463 AA) |
| Synthetic Δ5 desaturase derived from *Peridinium* sp. CCMP626, codon-optimized for expression in *Yarrowia lipolytica* ("RD5S") | 75 (1392 bp) | 76 (463 AA) |
| *Euglena anabaena* UTEX 373 Δ5 desaturase ("EaD5") | 77 (1362 bp) | 78 (454 AA) |
| Synthetic Δ5 desaturase derived from *Euglena anabaena* UTEX 373, codon-optimized for expression in *Yarrowia lipolytica* ("EaD5S") | 79 (1362 bp) | 80 (454 AA) |
| Synthetic mutant Δ5 desaturase ("EaD5SM"), derived from *Euglena anabaena* ("EaD5S") (U.S. Pat. Pub. No. 2010-0075386-A1) | 81 (1365 bp) | 82 (454 AA) |
| *Phytophthora ramorum* Δ17 desaturase ("PrD17") | 83 (1086 bp) | 84 (361 AA) |
| Synthetic Δ17 desaturase derived from *Phytophthora ramorum*, codon-optimized for expression in *Yarrowia lipolytica* ("PrD17S") | 85 (1086 bp) | 86 (361 AA) |
| *Pythium aphanidermatum* Δ17 desaturase ("PaD17") | 87 (1080 bp) | 88 (359 AA) |
| Synthetic Δ17 desaturase derived from *Pythium aphanidermatum*, codon-optimized for expression in *Yarrowia lipolytica* ("PaD17S") | 89 (1080 bp) | 90 (359 AA) |

TABLE 1-continued

Summary of Gene and Protein SEQ ID Numbers

| Description | Nucleic acid SEQ ID NO. | Protein SEQ ID NO. |
|---|---|---|
| *Fusarium moniliforme* Δ12 desaturase ("FmD12") | 91 (1434 bp) | 92 (477 AA) |
| Synthetic Δ12 desaturase derived from *Fusarium moniliforme*, codon-optimized for expression in *Yarrowia lipolytica* ("FmD12S") | 93 (1434 bp) | 94 (477 AA) |
| *Mortierella alpina* $C_{16/18}$ elongase | 95 (828 bp) | 96 (275 AA) |
| Synthetic $C_{16/18}$ elongase derived from *Mortierella alpina* ELO3, codon-optimized for expression in *Yarrowia lipolytica* ("ME3S") | 97 (828 bp) | 98 (275 AA) |
| Shindou et al. membrane bound O-acyltransferase motif WHGxxxGYxxxF | — | 99 |
| Shindou et al. membrane bound O-acyltransferase motif YxxxxF | — | 100 |
| Shindou et al. membrane bound O-acyltransferase motif YxxxYFxxH | — | 101 |
| U.S. Pat. Appl. Pub. No. 2008-0145867-A1 motif M[V/I]-[L/I]-xxK-[L/V/I]-xxxxxxDG | — | 102 |
| U.S. Pat. Appl. Pub. No. 2008-0145867-A1 motif RxKYYxxWxxx-[E/D]-[A/G]xxxxGxG-[F/Y]-xG | — | 103 |
| U.S. Pat. Appl. Pub. No. 2008-0145867-A1 motif SAxWHGxxPGYxx-[T/F]-F | — | 104 |
| Lewin, T. W. et al. & Yamashita et al. 1-acyl-sn-glycerol-3-phosphate acyltransferase motif GxxFI-[D/R]-R | — | 105 |
| Lewin, T. W. et al. 1-acyl-sn-glycerol-3-phosphate acyltransferase motif [V/I]-[P/X]-[I/V/L]-[I/V]-P-[V/I] | — | 106 |
| Yamashita et al. 1-acyl-sn-glycerol-3-phosphate acyltransferase motif IVPIVM | — | 107 |
| *Yarrowia lipolytica* Pex1p (GenBank Accession No. CAG82178) | — | 108 (1024 AA) |
| *Yarrowia lipolytica* Pex2p (GenBank Accession No. CAG77647) | — | 109 (381 AA) |
| *Yarrowia lipolytica* Pex3p (GenBank Accession No. CAG78565) | — | 110 (431 AA) |
| *Yarrowia lipolytica* Pex3Bp (GenBank Accession No. CAG83356) | — | 111 (395 AA) |
| *Yarrowia lipolytica* Pex4p (GenBank Accession No. CAG79130) | — | 112 (153 AA) |
| *Yarrowia lipolytica* Pex5p (GenBank Accession No. CAG78803) | — | 113 (598 AA) |
| *Yarrowia lipolytica* Pex6p (GenBank Accession No. CAG82306) | — | 114 (1024 AA) |
| *Yarrowia lipolytica* Pex7p (GenBank Accession No. CAG78389) | — | 115 (356 AA) |
| *Yarrowia lipolytica* Pex8p (GenBank Accession No. CAG80447) | — | 116 (671 AA) |
| *Yarrowia lipolytica* Pex10p (GenBank Accession No. CAG81606) | — | 117 (377 AA) |
| *Yarrowia lipolytica* Pex12p (GenBank Accession No. CAG81532) | — | 118 (408 AA) |

TABLE 1-continued

Summary of Gene and Protein SEQ ID Numbers

| Description | Nucleic acid SEQ ID NO. | Protein SEQ ID NO. |
|---|---|---|
| *Yarrowia lipolytica* Pex13p (GenBank Accession No. CAG81789) | — | 119 (412 AA) |
| *Yarrowia lipolytica* Pex14p (GenBank Accession No. CAG79323) | — | 120 (380 AA) |
| *Yarrowia lipolytica* Pex16p (GenBank Accession No. CAG79622) | — | 121 (391 AA) |
| *Yarrowia lipolytica* Pex17p (GenBank Accession No. CAG84025) | — | 122 (225 AA) |
| *Yarrowia lipolytica* Pex19p (GenBank Accession No. AAK84827) | — | 123 (324 AA) |
| *Yarrowia lipolytica* Pex20p (GenBank Accession No. CAG79226) | — | 124 (417 AA) |
| *Yarrowia lipolytica* Pex22p (GenBank Accession No. CAG77876) | — | 125 (195 AA) |
| *Yarrowia lipolytica* Pex26p (GenBank Accession No. NC_006072, antisense translation of nucleotides 117230-118387) | — | 126 (386 AA) |
| Plasmid pY116 | 127 (8739 bp) | — |
| Plasmid pZKSL-5S5A5 | 128 (13975 bp) | — |
| Plasmid pZP3-Pa777U | 129 (13066 bp) | — |
| Plasmid pZKUM | 130 (4313 bp) | — |
| Plasmid pZKL2-5mB89C | 131 (15991 bp) | — |
| Plasmid pZKL1-2SR9G85 | 132 (14554 bp) | — |
| Plasmid pZSCP-Ma83 | 133 (15119 bp) | — |
| Plasmid pZKL4-398F2 | 134 (14623 bp) | — |
| Plasmid pZP2-85m98F | 135 (14619 bp) | — |
| Plasmid pZK16-ML8N | 136 (15262 bp) | — |
| Plasmid pZK16-ML | 137 (13075bp) | — |
| Plasmid pZKL2-5m89C | 138 (15799 bp) | — |
| Plasmid pY201 | 139 (9641 bp) | — |
| *Escherichia coli* LoxP recombination site, recognized by a Cre recombinase enzyme | 140 (34 bp) | — |
| Primer 798 | 141 | — |
| Primer 799 | 142 | — |
| Primer 800 | 143 | — |
| Primer 801 | 144 | — |

TABLE 1-continued

Summary of Gene and Protein SEQ ID Numbers

| Description | Nucleic acid SEQ ID NO. | Protein SEQ ID NO. |
|---|---|---|
| Plasmid pY168 | 145 (9320 bp) | — |
| Plasmid pY208 | 146 (8726 bp) | — |
| Primer 856 | 147 | — |
| Primer 857 | 148 | — |
| Plasmid pY207 | 149 (8630 bp) | — |
| Plasmid pY175 | 150 (8630 bp) | — |
| Synthetic LPAAT derived from Saccharomyces cerevisiae, codon-optimized for expression in Yarrowia lipolytica ("ScLPAATS") | 151 (926 bp) | 152 (303 AA) |
| Plasmid pY222 | 153 (7891 bp) | — |
| Primer 869 | 154 | — |
| Primer 870 | 155 | — |
| Plasmid pY177 | 156 (9598 bp) | — |

DETAILED DESCRIPTION OF THE INVENTION

Described herein are production host strains of *Yarrowia lipolytica* that are capable of producing greater than 50% eicosapentaenoic acid ["EPA"; 20:5 ω-3]. Accumulation of this particular polyunsaturated fatty acid ["PUFA"] is accomplished by introduction of a functional ω-3/ω-6 fatty acid biosynthetic pathway comprising proteins with Δ9 elongase, Δ8 desaturase, Δ5 desaturase, Δ17 desaturase, Δ12 desaturase and $C_{16/18}$ elongase activities, which thereby enables production of an EPA oil with minimal γ-linolenic acid ["GLA"]. Thus, this disclosure demonstrates that *Y. lipolytica* can be engineered to enable commercial production of EPA and derivatives thereof. Methods of production, and oils therefrom, are also claimed.

PUFAs, such as EPA (or derivatives thereof), are used as dietary substitutes, or supplements, particularly infant formulas, for patients undergoing intravenous feeding or for preventing or treating malnutrition. Alternatively, the purified PUFAs (or derivatives thereof) may be incorporated into cooking oils, fats or margarines formulated so that in normal use the recipient would receive the desired amount for dietary supplementation. The PUFAs may also be incorporated into infant formulas, nutritional supplements or other food products and may find use as anti-inflammatory or cholesterol lowering agents. Optionally, the compositions may be used for pharmaceutical use, either human or veterinary.

Supplementation of humans or animals with PUFAs produced by recombinant means can result in increased levels of the added PUFAs, as well as their metabolic progeny. For example, treatment with EPA can result not only in increased levels of EPA, but also downstream products of EPA such as eicosanoids (i.e., prostaglandins, leukotrienes, thromboxanes), docosapentaenoic acid ["DPA"; cis-7, 10, 13, 16, 19-docosapentaenoic; 22:5 ω-3] and docosahexaenoic acid ["DHA"; cis-4, 7, 10, 13, 16, 19-docosahexaenoic acid; 22:6 ω-3]. Complex regulatory mechanisms can make it desirable to combine various PUFAs, or add different conjugates of PUFAs, in order to prevent, control or overcome such mechanisms to achieve the desired levels of specific PUFAs in an individual.

Alternately, PUFAs, or derivatives thereof, made by the methodology disclosed herein can be utilized in the synthesis of animal and aquaculture feeds, such as dry feeds, semi-moist and wet feeds, since these formulations generally require at least 1-2% of the nutrient composition to be ω-3 and/or ω-6 PUFAs.

All patents, patent applications, and publications cited herein are incorporated by reference in their entirety.

In this disclosure, a number of terms and abbreviations are used. The following definitions are provided.

"Open reading frame" is abbreviated as "ORF".

"Polymerase chain reaction" is abbreviated as "PCR".

"American Type Culture Collection" is abbreviated as "ATCC".

"Polyunsaturated fatty acid(s)" is abbreviated as "PUFA(s)".

"Triacylglycerols" are abbreviated as "TAGs".

"Co-enzyme A" is abbreviated as "CoA".

"Total fatty acids" are abbreviated as "TFAs".

"Fatty acid methyl esters" are abbreviated as "FAMEs".

"Dry cell weight" is abbreviated as "DCW".

As used herein the term "invention" or "present invention" is intended to refer to all aspects and embodiments of the invention as described in the claims and specification herein and should not be read so as to be limited to any particular embodiment or aspect.

The term "food product" refers to any food generally suitable for human consumption. Typical food products include, but are not limited to: meat products, cereal products, baked foods, snack foods, dairy products, beverages and the like. The terms "food analog", "functional food", "medical food" and "medical nutritional" are defined as in U.S. Pat. Appl. Pub. No. 2006-0115881-A1.

The term "pharmaceutical" as used herein means a compound or substance which if sold in the United States would be controlled by Section 503 or 505 of the Federal Food, Drug and Cosmetic Act.

The term "infant formula" means a food which is designed exclusively for consumption by the human infant by reason of its simulation of human breast milk. Typical commercial examples of infant formula include, but are not limited to: Similac® and Isomil®.

The term "dietary supplement" refers to a product that: (i) is intended to supplement the diet and thus is not represented for use as a conventional food or as a sole item of a meal or the diet; (ii) contains one or more dietary ingredients (including, e.g., vitamins, minerals, herbs or other botanicals, amino acids, enzymes and glandulars) or their constituents; (iii) is intended to be taken by mouth as a pill, capsule, tablet, or liquid; and, (iv) is labeled as being a dietary supplement.

The term "animal feed" refers to feeds intended exclusively for consumption by animals, including domestic animals such as pets, farm animals, etc. or for animals raised for the production of food, such as for e.g., fish farming. The terms "aquaculture feed", "aquafeed" and "feed nutrient" are as defined in U.S. Pat. Appl. Pub. No. 2006-0115881-A1.

As used herein the term "biomass" refers specifically to spent or used yeast cellular material from the fermentation of a recombinant production host producing EPA in commercially significant amounts, wherein the preferred production host is a recombinant strain of the oleaginous yeast, *Yarrowia lipolytica*. The biomass may be in the form of whole cells, whole cell lysates, homogenized cells, partially hydrolyzed cellular material, and/or partially purified cellular material (e.g., microbially produced oil).

The term "lipids" refer to any fat-soluble (i.e., lipophilic), naturally-occurring molecule. A general overview of lipids is provided in U.S. Pat. Appl. Pub. No. 2009-0093543-A1 (see Table 2 therein).

The term "glycerophospholipids" refers to a broad class of molecules, having a glycerol core with fatty acids at the sn-1 position and sn-2 position, and a polar head group (e.g., phosphate, choline, ethanolamine, glycerol, inositol, serine, cardiolipin) joined at the sn-3 position via a phosphodiester bond. Glycerophospholipids thus include phosphatidic acid ["PA"], phosphatidylcholines ["PC"], phosphatidylethanolamines ["PE"], phosphatidylglycerols ["PG"], phosphatidylinositols ["PI"], phosphatidylserines ["PS"] and cardiolipins ["CL"]. Glycerophospholipids possess tremendous diversity, not only resulting from variable phosphoyl head groups, but also as a result of differing chain lengths and degrees of saturation of their fatty acids. Generally, saturated and monounsaturated fatty acids are esterified at the sn-1 position, while polyunsaturated fatty acids are esterified at the sn-2 position.

"Lysophospholipids" are derived from glycerophospholipids, by deacylation of the sn-2 position fatty acid. Lysophospholipids include, e.g., lysophosphatidic acid ["LPA"], lysophosphatidylcholine ["LPC"], lysophosphatidyletanolamine ["LPE"], lysophosphatidylserine ["LPS"], lysophosphatidylglycerol ["LPG"] and lysophosphatidylinositol ["LPI"].

The term "oil" refers to a lipid substance that is liquid at 25° C. and usually polyunsaturated. In oleaginous organisms, oil constitutes a major part of the total lipid. "Oil" is composed primarily of triacylglycerols ["TAGs"] but may also contain other neutral lipids, phospholipids and free fatty acids. The fatty acid composition in the oil and the fatty acid composition of the total lipid are generally similar; thus, an increase or decrease in the concentration of PUFAs in the total lipid will correspond with an increase or decrease in the concentration of PUFAs in the oil, and vice versa.

"Neutral lipids" refer to those lipids commonly found in cells in lipid bodies as storage fats and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or triacylglycerol, respectively, or collectively, acylglycerols. A hydrolysis reaction must occur to release free fatty acids from acylglycerols.

The term "triacylglycerols" ["TAGs"] refers to neutral lipids composed of three fatty acyl residues esterified to a glycerol molecule. TAGs can contain long chain PUFAs and saturated fatty acids, as well as shorter chain saturated and unsaturated fatty acids.

The term "total fatty acids" ["TFAs"] herein refer to the sum of all cellular fatty acids that can be derivitized to fatty acid methyl esters ["FAMEs"] by the base transesterification method (as known in the art) in a given sample, which may be the biomass or oil, for example. Thus, total fatty acids include fatty acids from neutral lipid fractions (including diacylglycerols, monoacylglycerols and TAGs) and from polar lipid fractions (including, e.g., the PC and the PE fractions) but not free fatty acids.

The term "total lipid content" of cells is a measure of TFAs as a percent of the dry cell weight ["DCW"], although total lipid content can be approximated as a measure of FAMEs as a percent of the DCW ["FAMEs % DCW"]. Thus, total lipid content ["TFAs % DCW"] is equivalent to, e.g., milligrams of total fatty acids per 100 milligrams of DCW.

The concentration of a fatty acid in the total lipid is expressed herein as a weight percent of TFAs ["TFAs"], e.g., milligrams of the given fatty acid per 100 milligrams of TFAs. Unless otherwise specifically stated in the disclosure herein, reference to the percent of a given fatty acid with respect to total lipids is equivalent to concentration of the fatty acid as % TFAs (e.g., % EPA of total lipids is equivalent to EPA % TFAs).

In some cases, it is useful to express the content of a given fatty acid(s) in a cell as its weight percent of the dry cell weight ["% DCW"]. Thus, for example, EPA % DCW would be determined according to the following formula: (EPA % TFAs)*(TFAs % DCW)]/100. The content of a given fatty acid(s) in a cell as its weight percent of the dry cell weight ["% DCW"] can be approximated, however, as: (EPA % TFAs)* (FAMEs DCW)]/100.

The terms "lipid profile" and "lipid composition" are interchangeable and refer to the amount of individual fatty acids contained in a particular lipid fraction, such as in the total lipid or the oil, wherein the amount is expressed as a weight percent of TFAs. The sum of each individual fatty acid present in the mixture should be 100.

The term "extracted oil" refers to an oil that has been separated from other cellular materials, such as the microorganism in which the oil was synthesized. Extracted oils are obtained through a wide variety of methods, the simplest of which involves physical means alone. For example, mechanical crushing using various press configurations (e.g., screw, expeller, piston, bead beaters, etc.) can separate oil from cellular materials. Alternately, oil extraction can occur via treatment with various organic solvents (e.g., hexane), via enzymatic extraction, via osmotic shock, via ultrasonic extraction, via supercritical fluid extraction (e.g., $CO_2$ extraction), via saponification and via combinations of these methods. An extracted oil does not require that it is not necessarily purified or further concentrated. The extracted oils described herein will comprise at least 50 EPA % TFAs.

The term "blended oil" refers to an oil that is obtained by admixing, or blending, the extracted oil described herein with any combination of, or individual, oil to obtain a desired composition. Thus, for example, types of oils from different microbes can be mixed together to obtain a desired PUFA composition. Alternatively, or additionally, the PUFA-containing oils disclosed herein can be blended with fish oil, vegetable oil or a mixture of both to obtain a desired composition.

The term "fatty acids" refers to long chain aliphatic acids (alkanoic acids) of varying chain lengths, from about $C_{12}$ to $C_{22}$, although both longer and shorter chain-length acids are known. The predominant chain lengths are between $C_{16}$ and $C_{22}$. The structure of a fatty acid is represented by a simple notation system of "X:Y", where X is the total number of carbon ["C"] atoms in the particular fatty acid and Y is the number of double bonds. Additional details concerning the differentiation between "saturated fatty acids" versus "unsaturated fatty acids", "monounsaturated fatty acids" versus "polyunsaturated fatty acids" ["PUFAs"], and "omega-6 fatty acids" ["ω-6" or "n-6"] versus "omega-3 fatty acids" ["ω-3" or "n-3"] are provided in U.S. Pat. No. 7,238,482, which is hereby incorporated herein by reference.

Nomenclature used to describe PUFAs herein is given in Table 2. In the column titled "Shorthand Notation", the omega-reference system is used to indicate the number of carbons, the number of double bonds and the position of the double bond closest to the omega carbon, counting from the omega carbon, which is numbered 1 for this purpose. The remainder of the Table summarizes the common names of ω-3 and ω-6 fatty acids and their precursors, the abbreviations that will be used throughout the specification and the chemical name of each compound.

TABLE 2

Nomenclature of Polyunsaturated Fatty Acids And Precursors

| Common Name | Abbreviation | Chemical Name | Shorthand Notation |
|---|---|---|---|
| Myristic | — | tetradecanoic | 14:0 |
| Palmitic | Palmitate | hexadecanoic | 16:0 |
| Palmitoleic | — | 9-hexadecenoic | 16:1 |
| Stearic | — | octadecanoic | 18:0 |
| Oleic | — | cis-9-octadecenoic | 18:1 |
| Linoleic | LA | cis-9, 12-octadecadienoic | 18:2 ω-6 |
| γ-Linolenic | GLA | cis-6, 9, 12-octadecatrienoic | 18:3 ω-6 |
| Eicosadienoic | EDA | cis-11, 14-eicosadienoic | 20:2 ω-6 |
| Dihomo-γ-Linolenic | DGLA | cis-8, 11, 14-eicosatrienoic | 20:3 ω-6 |
| Arachidonic | ARA | cis-5, 8, 11, 14-eicosatetraenoic | 20:4 ω-6 |
| α-Linolenic | ALA | cis-9, 12, 15-octadecatrienoic | 18:3 ω-3 |
| Stearidonic | STA | cis-6, 9, 12, 15-octadecatetraenoic | 18:4 ω-3 |
| Eicosatrienoic | ETrA | cis-11, 14, 17-eicosatrienoic | 20:3 ω-3 |
| Sciadonic | SCI | cis-5, 11, 14-eicosatrienoic | 20:3b ω-6 |
| Juniperonic | JUP | cis-5, 11, 14, 17-eicosatetraenoic | 20:4b ω-3 |
| Eicosa-tetraenoic | ETA | cis-8, 11, 14, 17-eicosatetraenoic | 20:4 ω-3 |
| Eicosa-pentaenoic | EPA | cis-5, 8, 11, 14, 17-eicosapentaenoic | 20:5 ω-3 |
| Docosa-tetraenoic | DTA | cis-7, 10, 13, 16-docosatetraenoic | 22:4 ω-6 |

TABLE 2-continued

Nomenclature of Polyunsaturated Fatty Acids And Precursors

| Common Name | Abbreviation | Chemical Name | Shorthand Notation |
|---|---|---|---|
| Docosa-pentaenoic | DPAn-6 | cis-4, 7, 10, 13, 16-docosapentaenoic | 22:5 ω-6 |
| Docosa-pentaenoic | DPA | cis-7, 10, 13, 16, 19-docosapentaenoic | 22:5 ω-3 |
| Docosa-hexaenoic | DHA | cis-4, 7, 10, 13, 16, 19-docosahexaenoic | 22:6 ω-3 |

The term "PUFA biosynthetic pathway" refers to a metabolic process that converts oleic acid to ω-6 fatty acids such as LA, EDA, GLA, DGLA, ARA, DTA and DPAn-6 and ω-3 fatty acids such as ALA, STA, ETrA, ETA, EPA, DPA and DHA. This process is well described in the literature (e.g., see U.S. Pat. Appl. Pub. No. 2006-0115881-A1). Briefly, this process involves elongation of the carbon chain through the addition of carbon atoms and desaturation of the molecule through the addition of double bonds, via a series of special elongation and desaturation enzymes termed "PUFA biosynthetic pathway enzymes" that are present in the endoplasmic reticulum membrane. More specifically, "PUFA biosynthetic pathway enzymes" refer to any of the following enzymes (and genes which encode said enzymes) associated with the biosynthesis of a PUFA, including: Δ4 desaturase, Δ5 desaturase, Δ6 desaturase, Δ12 desaturase, Δ15 desaturase, Δ17 desaturase, Δ9 desaturase, Δ8 desaturase, Δ9 elongase, $C_{14/16}$ elongase, $C_{16/18}$ elongase, $C_{18/20}$ elongase and/or $C_{20/22}$ elongase.

The term "Δ9 elongase/Δ8 desaturase pathway" will refer to a PUFA biosynthetic pathway that minimally includes at least one Δ9 elongase and at least one Δ8 desaturase, thereby enabling biosynthesis of DGLA and/or ETA from LA and ALA, respectively, with EDA and/or ETrA as intermediate fatty acids. With expression of other desaturases and elongases, ARA, DTA, DPAn-6, EPA, DPA and DHA may also be synthesized.

The term "desaturase" refers to a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. Of particular interest herein are: Δ8 desaturases, Δ5 desaturases, Δ17 desaturases and Δ12 desaturases. Other useful desaturases can include Δ4 desaturases, Δ6 desaturases, Δ15 desaturases and Δ9 desaturases.

The term "elongase" refers to a polypeptide that can elongate a fatty acid carbon chain to produce an acid 2 carbons longer than the fatty acid substrate that the elongase acts upon. This process of elongation occurs in a multi-step mechanism in association with fatty acid synthase, as described in Intl. App. Pub. No. WO 2005/047480. Examples of reactions catalyzed by elongase systems are the conversion of GLA to DGLA, STA to ETA, ARA to DTA and EPA to DPA. In general, the substrate selectivity of elongases is somewhat broad but segregated by both chain length and the degree and type of unsaturation. For example, a $C_{14/16}$ elongase will utilize a $C_{14}$ substrate (e.g., myristic acid), a $C_{16/18}$ elongase will utilize a $C_{16}$ substrate (e.g., palmitate), a $C_{18/20}$ elongase will utilize a $C_{18}$ substrate (e.g., GLA, STA) and a $C_{20/22}$ elongase [also referred to as a Δ5 elongase or C20 elongase] will utilize a $C_{20}$ substrate (e.g., ARA, EPA). For the purposes herein, two distinct types of $C_{18/20}$ elongases can be defined: a Δ6 elongase will catalyze conversion of GLA and STA to DGLA and ETA, respectively, while a Δ9 elongase is able to catalyze the conversion of LA and ALA to EDA and ETrA, respectively.

The term "multizyme" or "fusion protein" refers to a single polypeptide having at least two independent and separable enzymatic activities, wherein the first enzymatic activity is preferably linked to the second enzymatic activity (U.S. Pat. Appl. Pub. No. 2008-0254191-A1). The "link" or "bond" between the at least two independent and separable enzymatic activities is minimally comprised of a single polypeptide bond, although the link may also be comprised of one amino acid residue, such as proline, or a polypeptide comprising at least one proline amino acid residue. Preferred linkers are selected from the group consisting of: SEQ ID NO:1, SEQ ID NO:2, SEQ ID NO:3, SEQ ID NO:4, SEQ ID NO:5, SEQ ID NO:6 and SEQ ID NO:7.

The term "DGLA synthase" refers to a multizyme, wherein a Δ9 elongase is linked to a Δ8 desaturase. The term "EgD9eS/EgD8M" refers to a DGLA synthase (SEQ ID NOs:8 and 9) created by linking the Δ9 elongase "EgD9eS" (U.S. Pat. No. 7,645,604) to the Δ8 desaturase "EgD8M" (U.S. Pat. No. 7,709,239) with a linker sequence (i.e., SEQ ID NO:1 [GAGPARPAGLPPATYYDSLAVMGS]; U.S. Pat. Appl. Pub. No. 2008-0254191-A1). Similarly, the term "EaD9eS/EaD8S" refers to a DGLA synthase (SEQ ID NOs: 10 and 11) created by linking the Δ9 elongase "EaD9eS" (U.S. Pat. Appl. Pub. No. 2008-0254522-A1) to the Δ8 desaturase "EaD8S" (U.S. Pat. Appl. Pub. No. 2008-0254521-A1) with the linker sequence set forth as SEQ ID NO:1. And, the term "E389D9eS/EgD8M" refers to a DGLA synthase (SEQ ID NOs:12 and 13) created by linking the Δ9 elongase "E389D9eS" (U.S. Pat. No. 7,645,604) to the Δ8 desaturase "EgD8M" (supra) with the linker sequence set forth as SEQ ID NO:1.

The terms "conversion efficiency" and "percent substrate conversion" refer to the efficiency by which a particular enzyme, such as a desaturase, elongase or multizyme, can convert substrate to product. The conversion efficiency is measured according to the following formula: ([product]/[substrate+product])*100, where 'product' includes the immediate product and all products in the pathway derived from it.

The term "$C_{18}$ to $C_{20}$ elongation conversion efficiency" refers to the efficiency by which $C_{18/20}$ elongases can convert $C_{18}$ substrates (i.e., LA, ALA, GLA, STA) to $C_{20}$ products (i.e., EDA, ETrA, DGLA, ETA). These $C_{18//20}$ elongases can be either Δ9 elongases or Δ6 elongases.

The term "Δ9 elongation conversion efficiency" refers to the efficiency by which Δ9 elongase can convert $C_{18}$ substrates (i.e., LA, ALA) to $C_{20}$ products (i.e., EDA, ETrA).

The term "acyltransferase" refers to an enzyme responsible for transferring an acyl group from a donor lipid to an acceptor lipid molecule.

The term "acyl-CoA:lysophospholipid acyltransferase" ["LPLAT"] refers to a broad class of acyltransferases, having the ability to acylate a variety of lysophospholipid substrates at the sn-2 position. More specifically, LPLATs include LPA acyltransferases ["LPAATs"] having the ability to catalyze conversion of LPA to PA, LPC acyltransferases ["LPCATs"] having the ability to catalyze conversion of LPC to PC, LPE acyltransferases ["LPEATs"] having the ability to catalyze conversion of LPE to PE, LPS acyltransferases ["LPLATs"] having the ability to catalyze conversion of LPS to PS, LPG acyltransferases ["LPGATs"] having the ability to catalyze conversion of LPG to PG, and LPI acyltransferases ["LPIATs"] having the ability to catalyze conversion of LPI to PI.

Standardization of LPLAT nomenclature has not been formalized, so various other designations are used in the art (for example, LPAATs have also been referred to as acyl-CoA:1-acyl-sn-glycerol-3-phosphate 2-O-acyltransferases, 1-acyl-sn-glycerol-3-phosphate acyltransferases and/or 1-acylglycerolphosphate acyltransferases ["AGPATs"] and LPCATs are often referred to as acyl-CoA:1-acyl lysophosphatidyl-choline acyltransferases). Additionally, it is important to note that some LPLATs, such as the *Saccharomyces cerevisiae* Ale1 (ORF YOR1750; SEQ ID NO:15), have broad specificity and thus a single enzyme may be capable of catalyzing several LPLAT reactions, including LPAAT, LPCAT and LPEAT reactions (Tamaki, H. et al., *J. Biol. Chem.*, 282:34288-34298 (2007); Stahl, U. et al., *FEBS Letters*, 582:305-309 (2008); Chen, Q. et al., *FEBS Letters*, 581:5511-5516 (2007); Benghezal, M. et al., *J. Biol. Chem.*, 282:30845-30855 (2007); Riekhof, et al., *J. Biol. Chem.*, 282:28344-28352 (2007)).

More specifically, the term "polypeptide having at least lysophosphtidylcholine acyltransferase ["LPCAT"] activity" will refer to those enzymes capable of catalyzing the reaction: acyl-CoA+1-acyl-sn-glycero-3-phosphocholine→CoA+1,2-diacyl-sn-glycero-3-phosphocholine (EC 2.3.1.23). LPCAT activity has been described in two structurally distinct protein families, i.e., the LPAAT protein family (Hishikawa, et al., *Proc. Natl. Acad. Sci. U.S.A.*, 105:2830-2835 (2008); Intl. App. Pub. No. WO 2004/076617) and the ALE1 protein family (Tamaki, H. et al., supra; Ståhl, U. et al., supra; Chen, Q. et al., supra; Benghezal, M. et al., supra; Riekhof, et al., supra).

The term "LPCAT" refers to a protein of the ALE1 protein family that: 1) has LPCAT activity (EC 2.3.1.23) and shares at least about 45% amino acid identity, based on the Clustal W method of alignment, when compared to an amino acid sequence selected from the group consisting of SEQ ID NO:15 (ScAle1) and SEQ ID NO:17 (YlAle1); and/or 2) has LPCAT activity (EC 2.3.1.23) and has at least one membrane bound O-acyltransferase ["MBOAT"] protein family motif selected from the group consisting of: M(V/I)LxxKL (SEQ ID NO:18), RxKYYxxW (SEQ ID NO:19), SAxWHG (SEQ ID NO:20) and $EX_{11}WNX_2$-[T/V]-$X_2W$ (SEQ ID NO:21). Examples of ALE1 polypeptides include ScAle1 and YlAle1.

The term "ScAle1" refers to a LPCAT (SEQ ID NO:15) isolated from *Saccharomyces cerevisiae* (ORF "YOR175C"), encoded by the nucleotide sequence set forth as SEQ ID NO:14. In contrast, the term "ScAle1S" refers to a synthetic LPCAT derived from *S. cerevisiae* that is codon-optimized for expression in *Yarrowia lipolytica* (i.e., SEQ ID NOs:22 and 23).

The term "YlAle1" refers to a LPCAT (SEQ ID NO:17) isolated from *Yarrowia lipolytica*, encoded by the nucleotide sequence set forth as SEQ ID NO:16.

The term "LPCAT" also refers to a protein that has LPCAT activity (EC 2.3.1.23) and shares at least about 90% amino acid identity, based on the Clustal W method of alignment, when compared to an amino acid sequence as set forth in SEQ ID NO:25 (CeLPCAT).

The term "CeLPCAT" refers to a LPCAT enzyme (SEQ ID NO:25) isolated from *Caenorhabditis elegans*, encoded by the nucleotide sequence set forth as SEQ ID NO:24. In contrast, the term "CeLPCATS" refers to a synthetic LPCAT derived from *C. elegans* that is codon-optimized for expression in *Yarrowia lipolytica* (i.e., SEQ ID NOs:26 and 27).

The term "polypeptide having at least lysophosphatidic acid acyltransferase ["LPAAT"] activity" will refer to those enzymes capable of catalyzing the reaction: acyl-CoA+1-acyl-sn-glycerol 3-phosphate→CoA+1,2-diacyl-sn-glycerol 3-phosphate (EC 2.3.1.51).

The term "LPAAT" refers to a protein that: 1) has LPAAT activity and shares at least about 43.9% amino acid identity, based on the Clustal W method of alignment, when compared to an amino acid sequence selected from the group consisting of SEQ ID NO:29 (MaLPAAT1), SEQ ID NO:31 (YIL-PAAT1) and SEQ ID NO:32 (ScLPAAT1); and/or, 2) has LPAAT activity and has at least one 1-acyl-sn-glycerol-3-phosphate acyltransferase family motif selected from the group consisting of: NHxxxxD (SEQ ID NO:33) and EGTR (SEQ ID NO:34). Examples of LPAAT polypeptides include ScLPAAT, MaLPAAT1 and YILPAAT1.

The term "ScLPAAT" refers to a LPAAT (SEQ ID NO:32) isolated from *Saccharomyces cerevisiae* (ORF "YDL052C").

The term "MaLPAAT1" refers to a LPAAT (SEQ ID NO:29) isolated from *Mortierella alpina*, encoded by the nucleotide sequence set forth as SEQ ID NO:28. In contrast, the term "MaLPAAT1S" refers to a synthetic LPAAT derived from *M. alpina* that is codon-optimized for expression in *Yarrowia lipolytica* (i.e., SEQ ID NOs:35 and 36).

The term "YILPAAT1" refers to a LPAAT (SEQ ID NO:31) isolated from *Yarrowia lipolytica*, encoded by the nucleotide sequence set forth as SEQ ID NO:30.

The term "ortholog" refers to a homologous protein from a different species that evolved from a common ancestor protein as evidenced by being in one Glade of phylogenetic tree analysis and that catalyzes the same enzymatic reaction.

The term "diacylglycerol cholinephosphotransferase" refers to an enzyme (EC 2.7.8.2) that catalyses the synthesis of phosphatidylcholines from CDP-choline and 1,2-diacylglycerols. This enzyme is part of the CDP-choline pathway, responsible for phosphatidylcholine ["PC"] biosynthesis.

The term "YICPT1" refers to a diacylglycerol cholinephosphotransferase enzyme (SEQ ID NO:38) isolated from *Yarrowia lipolytica*, encoded by SEQ ID NO:37. YICPT1 is described in Intl. App. Pub. No. WO 2006/052870 (see also Gen Bank Accession No. XM_501703 (YALI0C10989g)).

The term "malonic acid", also referred to as propanedioic acid according to International Union of Pure and Applied Chemistry ["IUPAC"] systematic nomenclature, refers to a dicarboxylic acid having the chemical structure set forth as $CH_2(COOH)_2$. The malonate or propanedioate ion is derived from malonic acid by loss of two hydrogen ions (i.e., $CH_2(COO)_2^{2-}$). Salts and esters of malonic acid include, but are not limited to, diethyl malonate $[(C_2H_5)_2(C_3H_2O_4)]$, dimethyl malonate $[(CH_3)_2(C_3H_2O_4)]$ and disodium malonate $[Na_2(C_3H_2O_4)]$.

"Malonates" refer to the ionised form of malonic acid, as well as its esters and salts. All of these are referred to herein collectively as "malonates".

"Malonyl-CoA" [CAS Registry No. 524-14-1] refers to an acyl thioester that can be formed by the carboxylation of acetyl-CoA to malonyl-CoA. Alternatively, malonyl-CoA is produced enzymatically from the substrate malonate, via a malonyl-CoA synthetase.

"Malonyl-CoA synthetase" [EC 6.2.1.-] catalyzes the following enzymatic reaction: malonate+ATP+CoA→malonyl-CoA+AMP+pyrophosphate (PPi). The enzyme was first purified from malonate-grown *Pseudomonas fluorescens* (Kim, Y. S, and S. K. Bang, *J. Biol. Chem.*, 260:5098-5104 (1985)), although various *Rhizobia* homologs have since been isolated from bacteroids within legume nodules (see, for example, Kim, Y. S, and H. Z. Chae, *Biochem. J.*, 273:511-516 (1991) and Kim, Y. S. and S. W. Kang, *Biochem. J.*, 297:327-333 (1994)).

As used herein, the term "rMCS" refers to a gene (SEQ ID NO:39) encoding malonyl-CoA synthetase (SEQ ID NO:40) isolated from *Rhizobium leguminosarum* bv. viciae 3841 (GenBank Accession No. YP_766603). Similarly, the term "MCS" refers to a synthetic gene encoding malonyl-CoA synthetase derived from *Rhizobium leguminosarum* bv. viciae 3841 that is codon-optimized for expression in *Yarrowia lipolytica* (i.e., SEQ ID NOs:41 and 42).

The term "peroxisomes" refers to ubiquitous organelles found in all eukaryotic cells. They have a single lipid bilayer membrane that separates their contents from the cytosol and that contains various membrane proteins essential to the functions described below. Peroxisomes selectively import proteins via an "extended shuttle mechanism". More specifically, there are at least 32 known peroxisomal proteins, called peroxins, which participate in the process of importing proteins by means of ATP hydrolysis through the peroxisomal membrane. Once cellular proteins are imported into the peroxisome, they are typically subjected to some means of degradation. For example, peroxisomes contain oxidative enzymes, such as e.g., catalase, D-amino acid oxidase and uric acid oxidase, that enable degradation of substances that are toxic to the cell. Alternatively, peroxisomes breakdown fatty acid molecules to produce free molecules of acetyl-CoA which are exported back to the cytosol, in a process called β-oxidation.

The terms "peroxisome biogenesis factor protein", "peroxin" and "Pex protein" are interchangeable and refer to proteins involved in peroxisome biogenesis and/or that participate in the process of importing cellular proteins by means of ATP hydrolysis through the peroxisomal membrane. The acronym of a gene that encodes any of these proteins is "Pex gene". A system for nomenclature is described by Distel et al., *J. Cell Biol.*, 135:1-3 (1996). At least 32 different Pex genes have been identified so far in various eukaryotic organisms. Many Pex genes have been isolated from the analysis of mutants that demonstrated abnormal peroxisomal functions or structures. Based on a review by Kiel, J. A. K. W., et al. (*Traffic*, 7:1291-1303 (2006)), wherein in silico analysis of the genomic sequences of 17 different fungal species was performed, the following Pex proteins were identified: Pex1p, Pex2p, Pex3p, Pex3 Bp, Pex4p, Pex5p, Pex5 Bp, Pex5 Cp, Pex5/20p, Pex6p, Pex7p, Pex8p, Pex10p, Pex12p, Pex13p, Pex14p, Pex15p, Pex16p, Pex17p, Pex14/17p, Pex18p, Pex19p, Pex20p, Pex21p, Pex21 Bp, Pex22p, Pex22p-like and Pex26p. Collectively, these proteins will be referred to herein as "Pex proteins", encoded by "Pex genes".

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The term "down-regulated" in or in connection with at least one peroxisome biogenesis factor protein refers to reduction in, or abolishment of, the activity of a native peroxisome biogenesis factor protein, as compared to the activity of the wildtype protein. Down-regulation typically occurs when a native Pex gene has a "disruption", referring to an insertion, deletion, or targeted mutation within a portion of that gene, that results in either a complete gene knockout such that the gene is deleted from the genome and no protein is translated or a translated Pex protein having an insertion, deletion, amino acid substitution or other targeted mutation. The location of the disruption in the protein may be, for example, within the N-terminal portion of the protein or within the C-terminal portion of the protein. The disrupted Pex protein will have impaired activity with respect to the Pex protein that was not disrupted, and can be non-functional. Down-regulation that results in low or lack of expression of the Pex protein, could also result via manipulating the regulatory sequences, transcription and translation factors and/or signal transduction pathways or by use of sense, antisense or RNAi technology, etc.

The term "oleaginous" refers to those organisms that tend to store their energy source in the form of oil (Weete, In: Fungal Lipid Biochemistry, 2nd Ed., Plenum, 1980). The term "oleaginous yeast" refers to those microorganisms classified as yeasts that can make oil. Generally, the cellular oil content of oleaginous microorganisms follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.*, 57:419-25 (1991)). It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

The term "fermentable carbon source" means a carbon source that a microorganism will metabolize to derive energy. Typical carbon sources include, but are not limited to: monosaccharides, oligosaccharides, polysaccharides, alkanes, fatty acids, esters of fatty acids, monoglycerides, diglycerides, triglycerides, carbon dioxide, methanol, formaldehyde, formate and carbon-containing amines.

The terms "polynucleotide", "polynucleotide sequence", "nucleic acid sequence", "nucleic acid fragment" and "isolated nucleic acid fragment" are used interchangeably herein. These terms encompass nucleotide sequences and the like. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures thereof. Nucleotides (usually found in their 5'-monophosphate form) are referred to by a single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Basic Local Alignment Search Tool; Altschul, S. F., et al., *J. Mol. Biol.*, 215: 403-410 (1993)). In general, a sequence of ten or more contiguous amino acids or thirty or more nucleotides is necessary in order to identify putatively a polypeptide or nucleic acid sequence as homologous to a known protein or gene. Moreover, with respect to nucleotide sequences, gene-specific oligonucleotide probes comprising 20-30 contiguous nucleotides may be used in sequence-dependent methods of gene identification (e.g., Southern hybridization) and isolation, such as in situ hybridization of bacterial colonies or bacteriophage plaques. In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence.

The term "complementary" is used to describe the relationship between nucleotide bases that are capable of hybridizing to one another. For example, with respect to DNA, adenosine is complementary to thymine and cytosine is complementary to guanine.

"Codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

"Synthetic genes" can be assembled from oligonucleotide building blocks that are chemically synthesized using procedures known to those skilled in the art. These oligonucleotide building blocks are annealed and then ligated to form gene segments that are then enzymatically assembled to construct the entire gene. Accordingly, the genes can be tailored for optimal gene expression based on optimization of nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell, where sequence information is available. For example, the codon usage profile for *Yarrowia lipolytica* is provided in U.S. Pat. No. 7,125,672.

"Gene" refers to a nucleic acid fragment that expresses a specific protein, and which may refer to the coding region alone or may include regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene that is introduced into the host organism by gene transfer. Foreign genes can comprise native genes inserted into a non-native organism, native genes introduced into a new location within the native host, or chimeric genes. A "transgene" is a gene that has been introduced into the genome by a transformation procedure. A "codon-optimized gene" is a gene having its frequency of codon usage designed to mimic the frequency of preferred codon usage of the host cell.

"Coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, silencers, 5' untranslated leader sequence (e.g., between the transcription start site and the translation initiation codon), introns, polyadenylation recognition sequences, RNA processing sites, effector binding sites and stem-loop structures.

"Promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters that cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The terms "3' non-coding sequence" and "transcription terminator" refer to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence.

The term "operably linked" refers to the association of nucleic acid sequences on a single nucleic acid fragment so that the function of one is affected by the other. For example, a promoter is operably linked with a coding sequence when it is capable of affecting the expression of that coding sequence. That is, the coding sequence is under the transcriptional control of the promoter. Coding sequences can be operably linked to regulatory sequences in sense or antisense orientation.

The term "expression", as used herein, refers to the transcription and stable accumulation of sense (mRNA) or antisense RNA. Expression may also refer to translation of mRNA into a polypeptide.

"Transformation" refers to the transfer of a nucleic acid molecule into a host organism. The nucleic acid molecule may be a plasmid that replicates autonomously, for example, or, it may integrate into the genome of the host organism. Host organisms containing the transformed nucleic acid fragments are referred to as "transgenic" or "recombinant" or "transformed" organisms or "transformant".

"Stable transformation" refers to the transfer of a nucleic acid fragment into the genome of a host organism, including both nuclear and organellar genomes, resulting in genetically stable inheritance (i.e., the nucleic acid fragment is "stably integrated"). In contrast, "transient transformation" refers to the transfer of a nucleic acid fragment into the nucleus, or DNA-containing organelle, of a host organism resulting in gene expression without integration or stable inheritance.

The terms "plasmid" and "vector" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction that is capable of introducing an expression cassette(s) into a cell.

The term "expression cassette" refers to a fragment of DNA comprising the coding sequence of a selected gene and regulatory sequences preceding (5' non-coding sequences) and following (3' non-coding sequences) the coding sequence that are required for expression of the selected gene product. Thus, an expression cassette is typically composed of: 1) a promoter sequence; 2) a coding sequence (i.e., ORF) and, 3) a 3' untranslated region (i.e., a terminator) that, in eukaryotes, usually contains a polyadenylation site. The expression cassette(s) is usually included within a vector, to facilitate cloning and transformation. Different expression cassettes can be transformed into different organisms including bacteria, yeast, plants and mammalian cells, as long as the correct regulatory sequences are used for each host.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1) the GCG suite of programs (Wisconsin Package Version 9.0, Genetics Computer Group (GCG), Madison, Wis.); 2) BLASTP, BLASTN, BLASTX (Altschul et al., *J. Mol. Biol.,* 215:403-410 (1990)); 3) DNAS-TAR (DNASTAR, Inc. Madison, Wis.); 4) Sequencher (Gene Codes Corporation, Ann Arbor, Mich.); and, 5) the FASTA program incorporating the Smith-Waterman algorithm (W. R. Pearson, *Comput. Methods Genome Res.*, [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used herein are well known in the art and are described by Sambrook, J., Fritsch, E. F. and Maniatis, T., Molecular Cloning: A Laboratory Manual, $2^{nd}$ ed., Cold Spring Harbor Laboratory: Cold Spring Harbor, N.Y. (1989) (hereinafter "Maniatis"); by Silhavy, T. J., Bennan, M. L. and Enquist, L. W., Experiments with Gene Fusions, Cold Spring Harbor Laboratory: Cold Spring Harbor, N.Y. (1984); and by Ausubel, F. M. et al., Current Protocols in Molecular Biology, published by Greene Publishing Assoc. and Wiley-Interscience, Hoboken, N.J. (1987).

In general, lipid accumulation in oleaginous microorganisms is triggered in response to the overall carbon to nitrogen ratio present in the growth medium. This process, leading to the de novo synthesis of free palmitate (16:0) in oleaginous microorganisms, is described in detail in U.S. Pat. No. 7,238, 482. Palmitate is the precursor of longer-chain saturated and unsaturated fatty acid derivates, which are formed through the action of elongases and desaturases (FIG. 1).

A wide spectrum of fatty acids (including saturated and unsaturated fatty acids and short-chain and long-chain fatty acids) can be incorporated into TAGs, the primary storage unit for fatty acids. In the methods and host cells described herein, incorporation of EPA into TAGs is most desirable, although the structural form of the EPA is not limiting (thus, for example, the EPA may exist in the total lipids as free fatty acids or in esterified forms such as acylglycerols, phospholipids, sulfolipids or glycolipids).

Although most PUFAs are incorporated into TAGs as neutral lipids and are stored in lipid bodies, it is important to note that a measurement of the total PUFAs within an oleaginous organism should minimally include those PUFAs that are located in the PC, PE and TAG fractions.

The metabolic process wherein oleic acid is converted to EPA involves elongation of the carbon chain through the addition of carbon atoms and desaturation of the molecule through the addition of double bonds. This requires a series of special desaturation and elongation enzymes present in the endoplasmic reticulum membrane. However, as seen in FIG. 1 and as described below, multiple alternate pathways exist for EPA production.

Specifically, FIG. 1 depicts the pathways described below. All pathways require the initial conversion of oleic acid to linoleic acid ["LA"], the first of the ω-6 fatty acids, by a Δ12 desaturase. Then, using the "Δ9 elongase/Δ8 desaturase pathway" and LA as substrate, long-chain ω-6 fatty acids are formed as follows: 1) LA is converted to eicosadienoic acid ["EDA"] by a Δ9 elongase; 2) EDA is converted to dihomo-γ-linolenic acid ["DGLA"] by a Δ8 desaturase; 3) DGLA is converted to arachidonic acid ["ARA"] by a Δ5 desaturase; 4) ARA is converted to docosatetraenoic acid ["DTA"] by a $C_{20/22}$ elongase; and, 5) DTA is converted to docosapentaenoic acid ["DPAn-6"] by a Δ4 desaturase.

The "Δ9 elongase/Δ8 desaturase pathway" can also use α-linolenic acid ["ALA"] as substrate to produce long-chain ω-3 fatty acids as follows: 1) LA is converted to ALA, the first of the ω-3 fatty acids, by a Δ15 desaturase; 2) ALA is converted to eicosatrienoic acid ["ETrA"] by a Δ9 elongase; 3) ETrA is converted to eicosatetraenoic acid ["ETA"] by a Δ8 desaturase; 4) ETA is converted to eicosapentaenoic acid ["EPA"] by a Δ5 desaturase; 5) EPA is converted to docosapentaenoic acid ["DPA"] by a $C_{20/22}$ elongase; and, 6) DPA is converted to docosahexaenoic acid ["DHA"] by a Δ4 desaturase. Optionally, ω-6 fatty acids may be converted to ω-3 fatty acids. For example, ETA and EPA are produced from DGLA and ARA, respectively, by Δ17 desaturase activity. Advantageously for the purposes herein, the Δ9 elongase/Δ8 desaturase pathway enables production of an EPA oil that lacks significant amounts of γ-linolenic acid ["GLA"].

Alternate pathways for the biosynthesis of ω-3/ω-6 fatty acids utilize a Δ6 desaturase and $C_{18/20}$ elongase, that is, the "Δ6 desaturase/Δ6 elongase pathway". More specifically, LA and ALA may be converted to GLA and stearidonic acid ["STA"], respectively, by a Δ6 desaturase; then, a $C_{18/20}$ elongase converts GLA to DGLA and/or STA to ETA.

Economical commercial production of EPA in a recombinant Yarrowia sp. host cell requires consideration of a variety of variables, including the EPA concentration ["EPA % TFAs"] and total lipid content ["TFAs % DCW"]. Furthermore, it is desirable to reduce the production of intermediate fatty acids and byproduct fatty acids in the final oil product, in order to maximize production of the desired fatty acid, i.e., EPA.

Intermediate fatty acids are those fatty acids (e.g., oleic acid, LA, ALA, EDA, DGLA, ETA) that can be further converted to EPA by the action of other metabolic pathway enzymes. In contrast, by-product fatty acids (e.g., sciadonic acid, juniperonic acid) refer to any fatty acid produced that is neither EPA nor an intermediate fatty acid that can be further converted to EPA.

U.S. Pat. Appl. Pub. No. 2009-0093543-A1 describes optimized strains of recombinant Yarrowia lipolytica having the ability to produce microbial oils comprising at least about 43.3 EPA % TFAs, with less than about 23.6 LA % TFAs (an EPA:LA ratio of 1.83). The preferred strain was Y4305, whose maximum production was 55.6 EPA % TFAs, with an EPA:LA ratio of 3.03. Generally, the EPA strains of U.S. Pat. Appl. Pub. No. 2009-0093543-A1 comprised the following genes of the ω-3/ω-6 fatty acid biosynthetic pathway:

a) at least one gene encoding Δ9 elongase; and,
    b) at least one gene encoding Δ8 desaturase; and,
    c) at least one gene encoding Δ5 desaturase; and,
    d) at least one gene encoding Δ17 desaturase; and,
    e) at least one gene encoding Δ2 desaturase; and,
    f) at least one gene encoding $C_{16/18}$ elongase; and,
    g) optionally, at least one gene encoding diacylglycerol cholinephosphotransferase (CPT1).

Examples of preferred genes having the enzymatic functionalities described above are set forth in Table 3 (although these genes are not intended to be limiting).

TABLE 3

Preferred Desaturases And Elongases For EPA Biosynthesis In Yarrowia lipolytica

| ORF | Organism | Co-pending Patent Application References | Wildtype Abbreviation and SEQ ID NO | Codon-Optimized Abbreviation and SEQ ID NO | Mutant Abbreviation and SEQ ID NO |
|---|---|---|---|---|---|
| Δ9 elongase | Euglena gracillis | U.S. Pat. No. 7,645,604 | "EgD9e" (SEQ ID NOs: 43 and 44) | "EgD9eS" (SEQ ID NOs: 45 and 46) | — |
| | Eutreptiella sp. CCMP389 | U.S. Pat. No. 7,645,604 | "E389D9e" (SEQ ID NOs: 47 and 48) | "E389D9eS" (SEQ ID NOs: 49 and 50) | — |
| | Euglena anabaena UTEX 373 | U.S. Pat. Appl. Pub. No. 2008-0254522-A1; Intl. App. Pub. No. WO 2008/128241 | "EaD9e"* (SEQ ID NOs: 51 and 52) | "EaD9eS" (SEQ ID NOs: 53 and 54) | — |
| Δ8 desaturase | Euglena gracilis | U.S. Pat. No. 7,256,033; U.S. Pat. No. 7,709,239 | "EgD8"* (SEQ ID NOs: 55 and 56) | "EgD8S"* (SEQ ID NOs: 57 and 58) | "EgD8M"* (SEQ ID NOs: 59 and 60) |
| | Euglena anabaena UTEX 373 | U.S. Pat. Appl. Pub. No. 2008-0254521-A1; Intl. App. Pub. No. WO 2008/124194 | "EaD8"* (SEQ ID NOs: 61 and 62) | "EaD8S" (SEQ ID NOs: 63 and 64) | |
| Δ5 desaturase | Euglena gracilis | U.S. Pat. No. 7,678,560; U.S. Pat. Pub. No. 2010-0075386-A1 | "EgD5" (SEQ ID NOs: 65 and 66) | "EgD5S" (SEQ ID NOs: 67 and 68) | "EgD5M" (SEQ ID NOs: 69 and 70); "EgD5SM" (SEQ ID NOs: 71 and 72) |

TABLE 3-continued

Preferred Desaturases And Elongases For EPA Biosynthesis In *Yarrowia lipolytica*

| ORF | Organism | Co-pending Patent Application References | Wildtype Abbreviation and SEQ ID NO | Codon-Optimized Abbreviation and SEQ ID NO | Mutant Abbreviation and SEQ ID NO |
|---|---|---|---|---|---|
| | *Peridinium* sp. CCMP626 | U.S. Pat. No. 7,695,950; U.S. Pat. Pub. No. 2010-0075386-A1 | "RD5" (SEQ ID NOs: 73 and 74) | "RD5S" (SEQ ID NOs: 75 and 76) | — |
| | *Euglena anabaena* UTEX 373 | U.S. Pat. Appl. Pub. No. 2008-0274521-A1; U.S. Pat. Pub. No. 2010-0075386-A1 | "EaD5"* (SEQ ID NOs: 77 and 78) | "EaD5S"* (SEQ ID NOs: 79 and 80) | "EaD5SM" (SEQ ID NOs: 81 and 82) |
| Δ17 desaturase | *Phytophthora ramorum* | U.S. Pat. No. 7,465,793 | "PrD17" (SEQ ID NOs: 83 and 84) | "PrD17S" (SEQ ID NOs: 85 and 86) | — |
| | *Pythium aphanidematum* | U.S. Pat. No. 7,556,949 | "PaD17" (SEQ ID NOs: 87 and 88) | "PaD17S" (SEQ ID NOs: 89 and 90) | — |
| Δ12 desaturase | *Fusarium moniliforme* | U.S. Pat. No. 7,504,259 | "FmD12"* (SEQ ID NOs: 91 and 92) | "FmD12S" (SEQ ID NOs: 93 and 94) | — |
| $C_{16/18}$ elongase | *Mortierella alpina* | U.S. Pat. No. 7,470,532 | "ELO3" (SEQ ID NOs: 95 and 96) | "ME3S" (SEQ ID NOs: 97 and 98) | — |
| Diacyl-glycerol choline-phospho-transferase | *Yarrowia lipolytica* | Intl. App. Pub. No. WO 2006/052870 | "YlCPT" (SEQ ID NOs: 37 and 38) | — | — |

*Notes: EaD9e was identified as "EaD9Elo1" in U.S. Pat. Appl. Pub. No. 2008-0254522-A1; EgD8 was identified as "Eg5" in U.S. Pat. No. 7,256,033; EgD8S was identified as "D8SF" in U.S. Pat. No. 7,256,033; EgD8M was identified as "EgD8S-23" in U.S. Pat. No. 7,709,239; EaD8 was identified as "EaD8Des3" in U.S. Pat. Appl. Pub. No. 2008-0254521-A1; EaD5 was identified as "EaD5Des1" in U.S. Pat. Appl. Pub. No. 2008-0274521-A1; and, FmD12 was identified as "Fm2" in U.S. Pat. No. 7,504,259.

Provided herein are optimized strains of recombinant *Yarrowia lipolytica* having the ability to produce improved microbial oils relative to those strains described in U.S. Pat. Appl. Pub. No. 2009-0093543-A1, based on the EPA % TFAs and the ratio of EPA:LA. In addition to expressing genes of the ω-3/ω-6 fatty acid biosynthetic pathway as defined above and as detailed in U.S. Pat. Appl. Pub. No. 2009-0093543-A1, these improved strains are distinguished by:

1) comprising at least one multizyme, wherein said multizyme comprises a polypeptide having at least one fatty acid Δ9 elongase linked to at least one fatty acid Δ8 desaturase [a "DGLA synthase"];
2) optionally comprising at least one polynucleotide encoding an enzyme selected from the group consisting of a malonyl CoA synthetase or an acyl-CoA lysophospholipid acyltransferase ["LPLAT"];
3) comprising at least one peroxisome biogenesis factor protein whose expression has been down-regulated;
4) producing at least about 50 EPA % TFAs; and,
5) having a ratio of EPA:LA of at least about 3.1.

U.S. Pat. Appl. Pub. No. 2008-0254191-A1, and especially Examples 55 and 56 which are hereby incorporated herein by reference, describes DGLA synthases that possess improved enzymatic activity with respect to their individual Δ9 elongase and/or Δ8 desaturase counterparts, when heterologously expressed in *Yarrowia lipolytica*. Particularly relevant to the disclosure herein, a linker sequence (i.e., SEQ ID NO:1 [GAGPARPAGLPPATYYDSLAVMGS]) was used to fuse a Δ9 elongase (i.e., EgD9eS, EaD9eS or E389D9eS) to a Δ8 desaturase (i.e., EgD8M or EaD8S), thereby creating EgD9eS/EgD8M (SEQ ID NOs:8 and 9), EaD9eS/EaD8S (SEQ ID NOs:10 and 11) and E389D9eS/EgD8M (SEQ ID NOs:12 and 13). Surprisingly, fusing the two independent enzymes together as one fusion protein separated by a linker region increased flux from LA to DGLA, suggesting that the product of Δ9 elongase may be directly channeled as substrate of Δ8 desaturase in the fusion protein.

Table 4 below provides a summary of the improvements noted in conversion efficiency in U.S. Pat. Appl. Pub. No. 2008-0254191-A1, as a result of the gene fusion. Specifically, the number shown in bold text is the percent improvement in elongase or desaturase activity, while the details shown in parentheses provide the elongase or desaturase conversion efficiency in the gene fusion versus when the elongase or desaturase conversion efficiency when the gene was expressed alone.

TABLE 4

Improvement In Δ9 Elongase And Δ8 Desaturase Conversion As A Result Of Gene Fusion

| Gene fusion | Δ9 Improvement | Δ8 Improvement |
|---|---|---|
| EgD9eS/EgD8M (SEQ ID NOs: 8 and 9) | 5% (21% versus 20% conversion) | 97% (73% versus 37% conversion) |
| EaD9eS/EaD8S (SEQ ID NOs: 10 and 11) | 38% (18% versus 13% conversion) | 32% (58% versus 41% conversion) |
| E389D9eS/EgD8M (SEQ ID NOs: 12 and 13) | 50% (18% versus 12% conversion) | 89% (70% versus 37% conversion) |

Based on the results described above, expression of at least one DGLA synthase, such as the EgD9eS/EgD8M, EaD9eS/EaD8S and E389D9eS/EgD8M gene fusions described above, is preferred in improved optimized strains of recombinant *Yarrowia lipolytica* having the ability to produce improved EPA % TFAs. This gene fusion can be created using any combination of preferred Δ9 elongases and Δ8 desaturases suitable for expression in *Y. lipolytica*; and, the linker can be selected from the group consisting of: SEQ ID NO:1, SEQ ID NO:2, SEQ ID NO:3, SEQ ID NO:4, SEQ ID NO:5, SEQ ID NO:6 and SEQ ID NO:7.

Previous studies have determined that many of the genetic mutations relating to engineering production of PUFAs in

*Yarrowia lipolytica* result in increased by production of malonates during the fermentation (malonates accounted for ~45% of the total organic acids accumulated). Expression of a heterologous malonyl-CoA synthetase reversed this effect and resulted in substantially reduced by production of malonates.

More specifically, U.S. patent application Ser. No. 12/637,877 (filed Dec. 15, 2009) describes generalized methods to avoid accumulation of organic acid (and in particular, malonate) "byproducts" that cannot be further utilized during a fermentation, during production of a product. This avoids carbon and energy waste within the organism, reduces the amount of base required to maintain an optimal pH range during the fermentation process, and reduces the amount of byproduct organic acids that require neutralization within the fermentation waste steam.

Malonyl-CoA synthetase [EC 6.2.1.-] catalyzes the following enzymatic reaction: malonate+ATP+CoA→malonyl-CoA+AMP+pyrophosphate (PPi). By converting the byproduct (i.e., malonate) into malonyl-CoA, this substrate becomes available for use during the synthesis of fatty acids within the organism. Specifically, fatty acid synthesis can be summarized by the following equation (ignoring $H^+$ and water): acetyl-CoA+7 malonyl-CoA+14 NADPH→palmitate+7 $CO_2$+14 $NADP^+$+8 CoA.

Expression of MCS (SEQ ID NO:42) in *Yarrowia lipolytica* strain Y4305U, producing 49 EPA % TFAs, lowered the total amount of malonates (g/g DCW) ~94% without impacting either the fatty acid profile or the total lipid yield (TFAs % DCW).

Based on the results described above, expression of at least one malonyl-CoA synthetase in improved optimized strains of recombinant *Yarrowia lipolytica* is desirable, as a means to reduce generation of unwanted byproducts and thereby decrease the cost of manufacture. Preferred malonyl-CoA synthetases are set forth as SEQ ID NOs:40 and 42, but these are should not be limiting to the disclosure herein. One skilled in the art could readily identify alternate heterologous malonyl-CoA synthetases suitable for expression in *Y. lipolytica*.

Glycerophospholipids, the main component of biological membranes, contain a glycerol core with fatty acids attached as R groups at the sn-1 position and sn-2 position, and a polar head group joined at the sn-3 position via a phosphodiester bond. Table 5 below summarizes the steps in the de novo biosynthetic pathway, originally described by Kennedy and Weiss (*J. Biol. Chem.*, 222:193-214 (1956)):

TABLE 5

General Reactions Of de Novo Glycerophospholipid Biosynthesis

| | |
|---|---|
| sn-Glycerol-3-Phosphate → Lysophosphatidic Acid (1-acyl-sn-glycerol 3-phosphate or "LPA") | Glycerol-3-phosphate acyltransferase (GPAT) [E.C. 2.3.1.15] esterifies 1st acyl-CoA to sn-1 position of sn-glycerol 3-phosphate |
| LPA → Phosphatidic Acid (1,2-diacylglycerol phosphate or "PA") | Lysophosphatidic acid acyltransferase (LPAAT) [E.C. 2.3.1.51] esterifies $2^{nd}$ acyl-CoA to sn-2 position of LPA |
| PA → 1,2-Diacylglycerol ("DAG") Or PA → Cytidine Diphosphate Diacylglycerol ("CDP-DG") | Phosphatidic acid phosphatase [E.C. 3.1.3.4] removes a phosphate from PA; DAG can subsequently be converted to phosphatidylcholines ["PC"], phosphatidylethanolamines ["PE"] or TAG (TAG synthesis requires either a diacylglycerol acyltransferase (DGAT) [E.C. 2.3.1.20] or a phospholipid:diacylglycerol acyltransferase (PDAT) [E.C.2.3.1.158]) CDP-diacylglycerol synthase [EC 2.7.7.41] causes condensation of PA and cytidine triphosphate, with elimination of pyrophosphate; CDP-DG can subsequently be converted to phosphatidylglycerols ["PG"], phosphatidylinositols ["PI"], phosphatidylserines ["PS"] or cardiolipins ["CL"] |

A codon-optimized malonyl-CoA synthetase was created and expressed in *Yarrowia lipolytica* in U.S. patent application Ser. No. 12/637,877. Specifically, the codon-optimized malonyl-CoA synthetase gene ("MCS", SEQ ID NO:41) was designed based on the coding sequence of the malonyl-CoA synthetase gene from *Rhizobium leguminosarum* bv. viciae 3841 (rMCS; SEQ ID NOs:39 and 40, corresponding to GenBank Accession No. YP_766603). In addition to modification of the translation initiation site, 233 by of the 1515 by coding region (including the stop codon) were modified (15.4%), 219 codons were optimized (43.4%), the GC content was reduced from 61.4% within the wild type gene (i.e., rMCS) to 55.6% within the synthetic gene (i.e., MCS) and the translation initiation codon "ATG" was added in front of the rMCS gene (SEQ ID NO:39) since *Yarrowia* cannot use the "GTG" codon for translation initiation. The codon-optimized MCS gene (SEQ ID NO:41) is 1518 by encoding a peptide of 505 amino acids and a stop codon (SEQ ID NO:42).

Following their de novo synthesis, glycerophospholipids can undergo rapid turnover of their fatty acyl composition at the sn-2 position. This "remodeling", or "acyl editing", has been attributed to deacylation of the glycerophospholipid and subsequent reacylation of the resulting lysophospholipid.

In the Lands' cycle (Lands, W. E., *J. Biol. Chem.*, 231:883-888 (1958)), remodeling occurs through the concerted action of: 1) a phospholipase, such as phospholipase $A_2$, that releases fatty acids from the sn-2 position of phosphatidylcholine; and, 2) acyl-CoA:lysophospholipid acyltransferases ["LPLATs"], such as lysophosphatidylcholine acyltransferase ["LPCAT"] that reacylates the lysophosphatidylcholine ["LPC"] at the sn-2 position. Other glycerophospholipids can also be involved in the remodeling with their respective lysophospholipid acyltransferase activity, including LPLAT enzymes having lysophosphatidylethanolamine acyltransferase ["LPEAT"] activity, lysophosphatidylserine acyltransferase ["LPLAT"] activity, lysophosphatidylglycerol acyltransferase ["LPGAT"] activity and lysophosphatidylinositol acyltransferase ["LPIAT"] activity. In all cases, LPLATs are responsible for removing acyl-CoA fatty acids from the cellular acyl-CoA pool and acylating various lysophospholipid substrates at the sn-2 position in the phospholipid pool. Finally, LPLATs also include LPAAT enzymes that are involved in the de novo biosynthesis of PA from LPA.

In other cases, this sn-2 position remodeling has been attributed to the forward and reverse reactions of enzymes having LPCAT activity (Stymne S, and A. K. Stobart, *Biochem. J.*, 223(2):305-314 (1984)).

Several recent reviews by Shindou et al. provide an overview of glycerophospholipid biosynthesis and the role of LPLATs (*J. Biol. Chem.*, 284(1):1-5 (2009); *J. Lipid Res.*, 50:S46-S51 (2009)). And, numerous LPLATs have been reported in public and patent literature, based on the presence of conserved motifs.

More specifically, a variety of LPLAT motifs have been proposed, with slight variation based on the specific species that are included in analyzed alignments. For example, Shindou et al. (*Biochem. Biophys. Res. Comm.*, 383:320-325 (2009)) proposed the following membrane bound O-acyltransferase ["MBOAT"] family motifs to be important for LPLAT activity, based on alignment of sequences from *Homo sapiens, Gallus gallus, Danio rerio* and *Caenorhabditis elegans*: WD, WHGxxxGYxxxF (SEQ ID NO:99), YxxxxF (SEQ ID NO:100) and YxxxYFxxH (SEQ ID NO:101). Of these, the WD, WHGxxxGYxxxF and YxxxxF motifs are present in ScAle1 (SEQ ID NO:15) and YlAle1 (SEQ ID NO:17), but the YxxxYFxxH motif is not. Alternate non-plant motifs for Ale1 homologs are also described in U.S. Pat. Appl. Pub. No. 2008-0145867-A1; specifically, these include: M-[V/I]-[L/I]-xxK-[L/V/1]-xxxxxxDG (SEQ ID NO:102), RxKYYxx-Wxxx-[E/D]-[A/G]xxxxGxG-[F/Y]-xG (SEQ ID NO:103), $EX_{11}WNX_2$-[T/V]-$X_2W$ (SEQ ID NO:21) and SAxWHGxx-PGYxx-[T/F]-F (SEQ ID NO:104).

Similarly, Lewin, T. W. et al. (*Biochemistry,* 38:5764-5771 (1999) and Yamashita et al. (*Biochim. Biophys. Acta,* 1771: 1202-1215 (2007)) proposed the following 1-acyl-sn-glycerol-3-phosphate acyltransferase ["LPAAT"] family motifs to be important for LPLAT activity, based on alignment of sequences from bacteria, yeast, nematodes and mammals: NHxxxxD (SEQ ID NO:33), GxxFI-[D/R]-R (SEQ ID NO:105), EGTR (SEQ ID NO:34) and either [V/I]-[P/X]-[I/V/L]-[I/V]-P-[V/I] (SEQ ID NO:106) or IVPIVM (SEQ ID NO:107). The NHxxxxD and EGTR motifs are present in MaLPAAT1 (SEQ ID NO:29), YlLPAAT1 (SEQ ID NO:31) and CeLPCAT (SEQ ID NO:25), but the other LPAAT family motifs are not.

Based on publicly available Ale1, LPCAT and LPAAT protein sequences, including those described herein, LPLATs for inclusion in the improved optimized strains of recombinant *Yarrowia lipolytica* herein possess either MBOAT family motifs selected from the group consisting of: M(V/I)LxxKL (SEQ ID NO:18), RxKYYxxW (SEQ ID NO:19), SAxWHG (SEQ ID NO:20) and $EX_{11}WNX_2$-[T/V]-$X_2W$ (SEQ ID NO:21) or 1-acyl-sn-glycerol-3-phosphate acyltransferase family motifs selected from the group consisting of: NHxxxxD (SEQ ID NO:33) and EGTR (SEQ ID NO:34).

The effect of LPLATs on PUFA production has been contemplated, since fatty acid biosynthesis requires rapid exchange of acyl groups between the acyl-CoA pool and the phospholipid pool. Specifically, desaturations occur mainly at the sn-2 position of phospholipids, while elongation occurs in the acyl-CoA pool.

More specifically, it has been previously hypothesized that LPCATs could be important in the accumulation of EPA in the TAG fraction of *Yarrowia lipolytica* (U.S. Pat. Appl. Pub. No. 2006-0115881-A1). As described therein, this hypothesis was based on the following studies: 1) Stymne S, and A. K. Stobart (*Biochem. J.*, 223(2):305-314 (1984)), who hypothesized that the exchange between the acyl-CoA pool and PC pool may be attributed to the forward and backward reaction of LPCAT; 2) Domergue, F. et al. (*J. Bio. Chem.*, 278:35115 (2003)), who suggested that accumulation of GLA at the sn-2 position of PC and the inability to efficiently synthesize ARA in yeast was a result of the elongation step involved in PUFA biosynthesis occurring within the acyl-CoA pool, while the Δ5 and Δ6 desaturation steps occurred predominantly at the sn-2 position of PC; 3) Abbadi, A. et al. (*The Plant Cell,* 16:2734-2748 (2004)), who suggested that LPCAT plays a critical role in the successful reconstitution of a Δ6 desaturase/Δ6 elongase pathway, based on analysis on the constraints of PUFA accumulation in transgenic oilseed plants; and, 4) the work of Renz, A. et al. in Intl. App. Publications No. WO 2004/076617 A2 and No. WO 2004/087902 A2.

More specifically, Intl. App. Pub. No. WO 2004/076617 A2 describes the isolation of a LPCAT from *Caenorhabditis elegans* (clone T06E8.1) ["CeLPCAT"] and reports increase in the efficiency of Δ6 desaturation and Δ6 elongation, as well as an increase in biosynthesis of the long-chain PUFAs eicosadienoic acid ["EDA"; 20:2] and eicosatetraenoic acid ["ETA"; 20:4], respectively, when the LPCAT was expressed in an engineered strain of *Saccharomyces cerevisiae* that was fed exogenous 18:2 or α-linolenic ["ALA"; 18:3] fatty acids, respectively.

Intl. App. Pub. No. WO 2004/087902 A2 (Example 16) describes the isolation of *Mortierella alpina* LPAAT-like proteins (encoded by proteins having 417 amino acids in length or 389 amino acids in length, respectively, that are identical except for an N-terminal extension of 28 amino acid residues) and reports expression of one of these proteins using similar methods to those of Intl. App. Pub. No. WO 2004/076617 A2, which results in similar improvements in EDA and ETA biosynthesis.

Both Intl. App. Publications No. WO 2004/076617 and No. WO 2004/087902 teach that the improvement in EDA and ETA biosynthesis is due to reversible LPCAT activity in CeLPLAT and some LPAAT-like proteins, although not all LPAAT-like proteins have LPCAT activity. Furthermore, Renz, A. et al. concluded that LPCAT allowed efficient and continuous exchange of the newly synthesized fatty acids between phospholipids and the acyl-CoA pool, since desaturases catalyze the introduction of double bonds in PC-coupled fatty acids while elongases exclusively catalyze the elongation of CoA esterified fatty acids (acyl-CoAs).

Numerous other references generally describe benefits of co-expressing LPLATs with PUFA biosynthetic genes, to increase the amount of a desired fatty acid in the oil of a transgenic organism, increase total oil content or selectively increase the content of desired fatty acids (e.g., Intl. App. Publications No. WO 2006/069936, No. WO 2006/052870, No. WO 2009/001315, No. WO 2009/014140).

Herein (and in Applicant's Assignee's co-filed U.S. Provisional Patent Application No. 61/187,359, filed Jun. 16, 2009, incorporated by reference in its entirety), it is demonstrated that LPAAT and LPCAT are indeed important in the accumulation of EPA in the TAG fraction of *Yarrowia lipolytica*. Specifically, it was found that over-expression of LPLATs can result in an improvement in the Δ9 elongase conversion efficiency. As previously defined, conversion efficiency is a term that refers to the efficiency by which a particular enzyme, such as a Δ9 elongase, can convert substrate (e.g., LA) to product (e.g., EDA). Thus, in a strain engineered to produce EPA, improvement in Δ9 elongase conversion efficiency was demonstrated to result in increased EPA % TFAs and/or EPA % DCW.

These results, and additional supporting work, are the cornerstone of the following claimed method for improving $C_{18}$ to $C_{20}$ elongation conversion efficiency in a LC-PUFA-producing recombinant oleaginous microbial host cell, wherein said method comprises:

a) introducing into said LC-PUFA-producing recombinant host cell at least one isolated polynucleotide encoding a polypeptide having at least acyl-CoA:lysophospholipid acyltransferase activity wherein the polypeptide is selected from the group consisting of:
  (i) a polypeptide having at least 45% amino acid identity, based on the Clustal W method of alignment, when compared to an amino acid sequence selected from the group consisting of SEQ ID NO:15 (ScAle1) and SEQ ID NO:17 (YlAle1);
  (ii) a polypeptide having at least one membrane bound O-acyltransferase protein family motif selected from the group consisting of: M(V/I)LxxKL (SEQ ID NO:18), RxKYYxxW (SEQ ID NO:19), SAxWHG (SEQ ID NO:20) and $EX_{11}WNX_2$-[T/V]-$X_2W$ (SEQ ID NO:21);
  (iii) a polypeptide having at least 90% amino acid identity, based on the Clustal W method of alignment, when compared to an amino acid sequence as set forth in SEQ ID NO:25 (CeLPCAT);
  (iv) a polypeptide having at least 43.9% amino acid identity, based on the Clustal W method of alignment, when compared to an amino acid sequence selected from the group consisting of SEQ ID NO:29 (MaLPAAT1), SEQ ID NO:31 (YlLPAAT1) and SEQ ID NO:32 (ScLPAAT1); and,
  (v) a polypeptide having at least one 1-acyl-sn-glycerol-3-phosphate acyltransferase protein family motif selected from the group consisting of: NHxxxxD (SEQ ID NO:33) and EGTR (SEQ ID NO:34);
wherein the at least one isolated polynucleotide encoding a polypeptide having at least acylCoA:lysophospholipid acyltransferase activity is operably linked to at least one regulatory sequence, said regulatory sequence being the same or different; and,
b) growing the oleaginous microbial host cell;
wherein the $C_{18}$ to $C_{20}$ elongation conversion efficiency of the oleaginous microbial host cell is increased relative to the control host cell.

Preferably, the polynucleotide encoding a polypeptide having at least acyl-CoA:lysophospholipid acyltransferase activity is stably integrated and the an increase in $C_{18}$ to $C_{20}$ elongation conversion is at least about 4%, More preferred, the increase in $C_{18}$ to $C_{20}$ elongation conversion efficiency is at least about 4-10%, more preferred at least about 10-20%, more preferred at least about 20-40%, and most preferred at least about 40-60% or greater in at least one LC-PUFA-producing oleaginous microbial host cell when compared to the control host cell.

Based on the improvement in $C_{18}$ to $C_{20}$ elongation conversion efficiency described above, optimized strains of recombinant Yarrowia lipolytica having the ability to produce improved EPA % TFAs, relative to those strains described in U.S. Pat. Appl. Pub. No. 2009-0093543-A1, will optionally comprise at least one acyl-CoA lysophospholipid acyltransferase ["LPLAT"] as defined in the methods described above. In preferred embodiments, the amino acid sequence of the LPLAT is selected from the group consisting of: SEQ ID NO:15 (ScAle1), SEQ ID NO:16 (YlAle1), SEQ ID NO:25 (CeLPCAT), SEQ ID NO:29 (MaLPAAT1), SEQ ID NO:31 (YlLPAAT1) and SEQ ID NO:32 (ScLPAAT1).

U.S. Pat. Appl. Pub. No. 2009-0093543-A1 describes a variety of knockouts useful in recombinant Yarrowia sp., including those useful for selection of transformants, those that diminish fatty acid degradation and TAG degradation and those that appear to result in a phenotypically "neutral" mutation (wherein the Yarrowia host cell seems unaffected). Most preferred, however, are those gene knockouts (e.g., diacylglycerol acyltransferase gene knockouts, peroxisome biogenesis factor protein ["PEX"] gene knockouts) that result in increases in the concentration of EPA relative to the total fatty acids ["EPA % TFAs"].

More specifically, U.S. Pat. Appl. Pub. No. 2009-0093543-A1 contemplates that in some preferred recombinant Yarrowia production hosts, the host is devoid of a native gene encoding a peroxisome biogenesis factor protein selected from the group consisting of: Pex1p (SEQ ID NO:108), Pex2p (SEQ ID NO:109), Pex3p (SEQ ID NO:110), Pex3Bp (SEQ ID NO:111), Pex4p (SEQ ID NO:112), Pex5p (SEQ ID NO:113), Pex6p (SEQ ID NO:114), Pex7p (SEQ ID NO:115), Pex8p (SEQ ID NO:116), Pex10p (SEQ ID NO:117), Pex12p (SEQ ID NO:118), Pex13p (SEQ ID NO:119), Pex14p (SEQ ID NO:120), Pex16p (SEQ ID NO:121), Pex17p (SEQ ID NO:122), Pex19p (SEQ ID NO:123), Pex20p (SEQ ID NO:124), Pex22p (SEQ ID NO:125) and Pex26p (SEQ ID NO:126). More preferred disrupted peroxisome biogenesis factor proteins are Pex2p, Pex3p, Pex10p, Pex12p and Pex16p, although data is provided only concerning Pex10p.

Intl. App. Pub. No. WO 2009/046248 confirms and expands the hypotheses and studies presented in U.S. Pat. Appl. Pub. No. 2009-0093543-A1, by comparing ΔPex16, ΔPex3 and ΔPex10 strains of Yarrowia lipolytica. Results therein demonstrated that Pex10 disruption was responsible for a 3.3 fold increase in EPA % TFAs and a 1.7 fold increase in the amount of $C_{20}$ PUFAs relative to the non-disrupted strain engineered for EPA production. Similarly, a 1.65 fold increase in DGLA TFAs and a 1.3 fold increase in $C_{20}$ PUFAs % TFAs was observed in a ΔPex16 strain engineered for DGLA production. A 2.0 fold increase in DGLA % TFAs and a 1.7 fold increase in $C_{20}$ PUFAs % TFAs was observed in a ΔPex3 strain engineered for DGLA production.

These results, and additional supporting work, are the cornerstone of the following claimed method for increasing the weight percent of one PUFA or a combination of PUFAs relative to the weight percent of total fatty acids in an oleaginous eukaryotic organism having a total lipid content, a total lipid fraction and an oil fraction, said method comprising:
  a) providing an oleaginous eukaryotic organism comprising a disruption in a native gene encoding a peroxisome biogenesis factor protein, which creates a PEX-disruption organism; and genes encoding a functional PUFA biosynthetic pathway; and,
  b) growing the PEX-disrupted organism under conditions wherein the weight percent of at least one PUFA is increased in the total lipid fraction and in the oil fraction relative to the weight percent of the total fatty acids, when compared with those weight percents in an oleaginous eukaryotic organism whose native peroxisome biogenesis factor protein has not been disrupted.

The amount of PUFAs that increases as a percent of total fatty acids can be: 1) the PUFA that is the desired end product of a functional PUFA biosynthetic pathway, as opposed to PUFA intermediates or by-products; 2) $C_{20}$ to $C_{22}$ PUFAs; and/or, 3) total PUFAs.

In addition to the increase in the weight percent of one or a combination of PUFAs relative to the weight percent of the total fatty acids, in some cases, the total lipid content (TFA % DCW) of the cell may be increased or decreased. What this means is that regardless of whether the disruption in the PEX gene causes the amount of total lipids in the PEX-disrupted cell to increase or decrease, the disruption always causes the weight percent of a PUFA or of a combination of PUFAs to increase.

Based on the above, optimized strains of recombinant *Yarrowia lipolytica* having the ability to produce improved EPA % TFAs, relative to those strains described in U.S. Pat. Appl. Pub. No. 2009-0093543-A1, will comprise at least one peroxisome biogenesis factor protein whose expression has been down-regulated (i.e., thereby producing a PEX-disrupted organism). In preferred strains, the down-regulated peroxisome biogenesis factor protein is Pex3p (SEQ ID NO:110), Pex10p (SEQ ID NO:117), or Pex16p (SEQ ID NO:121).

Although numerous techniques are available to one of skill in the art to achieve disruption of a native *Yarrowia* gene, generally the endogenous activity of a particular gene can be reduced or eliminated by the following techniques, for example: 1) disrupting the gene through insertion, substitution and/or deletion of all or part of the target gene; or, 2) manipulating the regulatory sequences controlling the expression of the protein. Both of these techniques are discussed in U.S. Pat. Appl. Pub. No. 2009-0093543-A1, as well as Intl. App. Pub. No. WO 2009/046248. One skilled in the art would appreciate that these and other methods are well described in the existing literature and are not limiting to the methods, host cells, and products described herein. One skilled in the art will also appreciate the most appropriate technique for use with any particular oleaginous yeast.

The optimized strains will produce at least about 40-50 EPA % TFAs, preferably at least about 50-55 EPA % TFAs, more preferably at least about 55-60 EPA % TFAs, more preferably at least 60-70 EPA % TFAs, and most preferably at least about 70-80 EPA % TFAs.

As will be clear to one of skill in the art, a multitude of different optimized *Yarrowia* strains producing at least about 50 EPA % TFAs could be engineered using the methodologies described herein. Selection of a preferred strain for commercial purposes will therefore also consider the total lipid content of the engineered strain, since both the concentration of EPA as a percent of the total fatty acids ["EPA % TFAs"] and total lipid content ["TFAs % DCW"] affect the cellular content of EPA as a percent of the dry cell weight ["EPA % DCW"]. That is, EPA % DCW is calculated as: (EPA % TFAs)*(TFA % DCW)]/100. For example, a strain producing 50 EPA % TFAs and having 24 TFAs % DCW, a strain producing 55 EPA % TFAs and having 21.82 TFAs % DCW, a strain producing 60 EPA % TFAs and having 20 TFAs % DCW, a strain producing 65 EPA % TFAs and having 18.46 TFAs % DCW and a strain producing 70 EPA % TFAs and having 17.14 TFAs % DCW all produce 12 EPA % DCW. In preferred embodiments, the improved optimized strain of *Yarrowia* lipolytica will produce at least about 10-12 EPA % DCW, preferably at least about 12-14 EPA % DCW, more preferably at least about 14-16 EPA % DCW, more preferably at least about 16-18 EPA % DCW, more preferably at least about 18-20 EPA % DCW, more preferably at least about 20-22 EPA DCW, more preferably at least about 22-24 EPA % DCW, and most preferably at least about 24-26 EPA % DCW.

In addition to possessing at least about 50 EPA % TFAs, the lipid profile within the improved optimized strain of *Yarrowia* lipolytica, or within extracted or unconcentrated oil therefrom, will have a ratio of EPA % TFAs to LA % TFAs of at least about 3.1. As demonstrated in U.S. Pat. Appl. Pub. No. 2009-0093543-A1 (Table 23), EPA, LA and oleic acid constituted approximately 76-80% of the fatty acids present in the lipid profile of a strain of *Y. lipolytica* producing greater than 40 EPA % TFAs. Of this, LA % TFAs was ca. three-fold greater than oleic acid % TFAs. Based on these observations, one of skill in the art will appreciate that minimizing the concentration of the intermediate fatty acid, LA (resulting in increased ratios of EPA:LA), will result in greater "pushing" of the carbon through the PUFA biosynthetic pathway and permit increased synthesis of EPA. In preferred embodiments, the ratio of EPA:LA will be at least about 3.1-3.5, more preferably at least about 3.5-4.5, more preferably at least about 4.5-5.5, and most preferably at least about 5.5-6.5.

Lipids produced by the improved optimized recombinant *Y. lipolytica* strains described herein will also be distinguished as having less than about 0.5% GLA or DHA (when measured by GC analysis using equipment having a detectable level down to about 0.1%) and having a saturated fatty acid content of less than about 8%. This low percent of saturated fatty acids (i.e., 16:0 and 18:0) results in substantial health benefits to humans and animals.

Microbial expression systems and expression vectors containing regulatory sequences that direct high-level expression of foreign proteins are well known to those skilled in the art. Any of these could be used to construct chimeric genes encoding the preferred desaturase, elongase, CPT1, DGLA synthase, malonyl CoA synthetase and acyl-CoA lysophospholipid acyltransferase proteins. These chimeric genes could then be introduced into *Yarrowia lipolytica* using standard methods of transformation to provide high-level expression of the encoded enzymes.

Vectors (e.g., constructs, plasmids) and DNA expression cassettes useful for the transformation of *Yarrowia* host cells are well known in the art. The specific choice of sequences present in the construct is dependent upon the desired expression products, the nature of the host cell, and the proposed means of separating transformed cells versus non-transformed cells. Typically, however, the vector contains at least one expression cassette, a selectable marker and sequences allowing autonomous replication or chromosomal integration. Suitable expression cassettes typically comprise a region 5' of the gene that controls transcriptional initiation (e.g., a promoter), the gene coding sequence, and a region 3' of the DNA fragment that controls transcriptional termination (i.e., a terminator). It is most preferred when both control regions are derived from genes from the transformed host cell, although they need not be derived from genes native to the production host (e.g., *Yarrowia lipolytica*).

Where two or more genes are expressed from separate replicating vectors, it is desirable that each vector has a different means of selection and should lack homology to the other constructs to maintain stable expression and prevent reassortment of elements among constructs. Judicious choice of regulatory regions, selection means and method of propagation of the introduced construct can be experimentally determined so that all introduced genes are expressed at the necessary levels to provide for synthesis of the desired products.

Constructs or vectors comprising the gene(s) of interest may be introduced into a host cell such as *Yarrowia* by any standard technique. These techniques include transformation (e.g., lithium acetate transformation [*Methods in Enzymology*, 194:186-187 (1991)]), bolistic impact, electroporation, microinjection, or any other method that introduces the gene(s) of interest into the host cell. More preferred herein for

*Yarrowia lipolytica* are integration techniques based on linearized fragments of DNA, as described in U.S. Pat. No. 4,880,741 and U.S. Pat. No. 5,071,764 and Chen, D. C. et al. (*Appl. Microbiol. Biotechnol.*, 48(2):232-235 (1997)).

For convenience, a host cell that has been manipulated by any method to take up a DNA sequence (e.g., an expression cassette) is referred to herein as "transformed", "transformant" or "recombinant". The transformed host will have at least one copy of the expression cassette and may have two or more, depending upon whether the expression cassette is integrated into the genome or is present on an extrachromosomal element having multiple copy numbers. The transformed host cell can be identified by various selection techniques, as described in U.S. Pat. No. 7,238,482 and U.S. Pat. No. 7,259,255.

Preferred selection methods for use herein are resistance to kanamycin, hygromycin and the amino glycoside G418, as well as ability to grow on media lacking uracil, leucine, lysine, tryptophan or histidine. In alternate embodiments, 5-fluoroorotic acid (5-fluorouracil-6-carboxylic acid monohydrate; "5-FOA") is used for selection of yeast Ura– mutants (U.S. Pat. Appl. Pub. No. 2009-0093543-A1), or a native acetohydroxyacid synthase (or acetolactate synthase; E.G. 4.1.3.18) that confers sulfonyl urea herbicide resistance (Intl. App. Pub. No. WO 2006/052870) is utilized for selection of transformants. A unique method of "recycling" a pair of preferred selection markers for their use in multiple sequential transformations, by use of site-specific recombinase systems, is also taught in U.S. Pat. Appl. Pub. No. 2009-0093543-A1.

As is well known to one of skill in the art, merely inserting a gene (e.g., a desaturase, elongase, CPT1, DGLA synthase, malonyl CoA synthetase, acyl-CoA lysophospholipid acyltransferase) into a cloning vector does not ensure its expression at the desired rate, concentration, amount, etc. It may be desirable to manipulate a number of different genetic elements that control aspects of transcription, RNA stability, translation, protein stability and protein location, oxygen limitation and secretion from the host cell. More specifically, gene expression may be controlled by altering the following: the nature of the relevant transcriptional promoter and terminator sequences; the number of copies of the cloned gene; whether the gene is plasmid-borne or integrated into the genome of the host cell; the final cellular location of the synthesized foreign protein; the efficiency of translation in the host organism; the intrinsic stability of the cloned gene protein within the host cell; and, the codon usage within the cloned gene, such that its frequency approaches the frequency of preferred codon usage of the host cell. Several of these methods of overexpression will be discussed below, and are useful in recombinant *Yarrowia* host cells as a means to overexpress e.g., desaturases, elongases, CPT1 proteins, DGLA synthases, malonyl CoA synthetases and acyl-CoA lysophospholipid acyltransferases.

Expression of the desired gene(s) can be increased at the transcriptional level through the use of a stronger promoter (either regulated or constitutive) to cause increased expression, by removing/deleting destabilizing sequences from either the mRNA or the encoded protein, or by adding stabilizing sequences to the mRNA (U.S. Pat. No. 4,910,141).

Transcription initiation control regions or promoters which are useful to drive expression of heterologous genes or portions thereof in *Yarrowia* host cells are numerous and known to those skilled in the art. Expression can be accomplished in an induced or constitutive fashion. Induced expression can be accomplished by inducing the activity of a regulatable promoter operably linked to the gene of interest, while constitutive expression can be achieved by the use of a constitutive promoter operably linked to the gene of interest. Virtually any promoter (i.e., native, synthetic, or chimeric) capable of directing expression of desaturase, elongase, CPT1, DGLA synthase, malonyl CoA synthetase and acyl-CoA lysophospholipid acyltransferase genes in *Yarrowia* will be suitable, although transcriptional and translational regions from the host species are particularly useful.

In general, the termination region can be derived from the 3' region of the gene from which the initiation region was obtained or from a different gene. A large number of termination regions are known and function satisfactorily in a variety of hosts when utilized both in the same and different genera and species from which they were derived. The termination region usually is selected more as a matter of convenience rather than because of any particular property. Preferably, the termination region is derived from a yeast gene. The 3'-region can also be synthetic, as one of skill in the art can utilize available information to design and synthesize a 3'-region sequence that functions as a transcription terminator. A termination site may be unnecessary, but it is highly preferred.

Although not intended to be limiting, preferred promoter regions and termination regions useful in the disclosure herein are those taught in U.S. Pat. Pub. No. 2009-0093543-A1.

Additional copies (i.e., more than one copy) of the PUFA biosynthetic pathway desaturase, elongase and DGLA synthase genes and/or CPT1, malonyl CoA synthetase and acyl-CoA lysophospholipid acyltransferase genes may be introduced into *Yarrowia lipolytica* to thereby increase EPA production and accumulation. Specifically, additional copies of genes may be cloned within a single expression construct; and/or, additional copies of the cloned gene(s) may be introduced into the host cell by increasing the plasmid copy number or by multiple integration of the cloned gene into the genome (infra).

It is important to note that the when preparing optimized strains of *Y. lipolytica* according to the methodology herein, copies of various desaturases, elongases, CPT1 s, DGLA synthases, malonyl CoA synthetases and acyl-CoA lysophospholipid acyltransferases are often referred to. If, for example, 2 copies of a Δ9 elongase are required, this can refer to: 1) two copies of an identical coding sequence for a particular Δ9 elongase isolated from a single species; or, 2) one coding sequence for a Δ9 elongase isolated from a species "A" and one coding sequence for a Δ9 elongase isolated from a species "B", thus collectively resulting in two Δ9 elongases.

In general, once a DNA cassette (e.g., comprising a chimeric gene comprising a promoter, ORF and terminator) suitable for expression in an oleaginous yeast has been obtained, it is either placed in a plasmid vector capable of autonomous replication in a host cell or directly integrated into the genome of the host cell. Integration of expression cassettes can occur randomly within the host genome or can be targeted through the use of constructs containing regions of homology with the host genome sufficient to target recombination with the host locus. Although not relied on herein, all or some of the transcriptional and translational regulatory regions can be provided by the endogenous locus where constructs are targeted to an endogenous locus.

The preferred method of expressing genes in *Yarrowia lipolytica* is by integration of a linear DNA fragment into the genome of the host. Integration into multiple locations within the genome can be particularly useful when high level expression of genes are desired. Preferred loci include those taught in U.S. Pat. Pub. No. 2009-0093543-A1.

Juretzek et al. (*Yeast*, 18:97-113 (2001)) note that the stability of an integrated DNA fragment in *Yarrowia lipolytica* is dependent on the individual transformants, the recipient strain and the targeting platform used. Thus, the skilled artisan will recognize that multiple transformants must be screened in order to obtain a strain displaying the desired expression level and pattern. Such screening may be accomplished by Southern analysis of DNA blots (Southern, *J. Mol. Biol.*, 98:503 (1975)), Northern analysis of mRNA expression (Kroczek, *J. Chromatogr. Biomed. Appl.*, 618 (1-2):133-145 (1993)), Western analysis of protein expression, phenotypic analysis or GC analysis of the PUFA products.

The transformed microbial host cell is grown under conditions that optimize expression of chimeric genes (e.g., encoding desaturases, elongases, CPT1, DGLA synthases, malonyl CoA synthetases, acyl-CoA lysophospholipid acyltransferases) and produce the greatest and the most economical yield of EPA. In general, media conditions may be optimized by modifying the type and amount of carbon source, the type and amount of nitrogen source, the carbon-to-nitrogen ratio, the amount of different mineral ions, the oxygen level, growth temperature, pH, length of the biomass production phase, length of the oil accumulation phase and the time and method of cell harvest. *Yarrowia lipolytica* are generally grown in a complex media such as yeast extract-peptone-dextrose broth ["YPD"] or a defined minimal media that lacks a component necessary for growth and thereby forces selection of the desired expression cassettes (e.g., Yeast Nitrogen Base (DIFCO Laboratories, Detroit, Mich.)).

Fermentation media for the methods and host cells described herein must contain a suitable carbon source, such as are taught in U.S. Pat. No. 7,238,482 and U.S. patent application Ser. No. 12/641,929 (filed Dec. 19, 2009). Although it is contemplated that the source of carbon utilized in the present invention may encompass a wide variety of carbon-containing sources, preferred carbon sources are sugars, glycerol and/or fatty acids. Most preferred is glucose, sucrose, invert sucrose, fructose and/or fatty acids containing between 10-22 carbons.

Nitrogen may be supplied from an inorganic (e.g., $(NH_4)_2SO_4$) or organic (e.g., urea or glutamate) source. In addition to appropriate carbon and nitrogen sources, the fermentation media must also contain suitable minerals, salts, cofactors, buffers, vitamins and other components known to those skilled in the art suitable for the growth of the high EPA-producing oleaginous yeast and the promotion of the enzymatic pathways for EPA production. Particular attention is given to several metal ions, such as $Fe^{+2}$, $Cu^{+2}$, $Mn^{+2}$, $Co^{+2}$, $Zn^{+2}$ and $Mg^{+2}$, that promote synthesis of lipids and PUFAs (Nakahara, T. et al., *Ind. Appl. Single Cell Oils*, D. J. Kyle and R. Colin, eds. pp 61-97 (1992)).

Preferred growth media for the methods and host cells described herein are common commercially prepared media, such as Yeast Nitrogen Base (DIFCO Laboratories, Detroit, Mich.). Other defined or synthetic growth media may also be used and the appropriate medium for growth of *Yarrowia lipolytica* will be known by one skilled in the art of microbiology or fermentation science. A suitable pH range for the fermentation is typically between about pH 4.0 to pH 8.0, wherein pH 5.5 to pH 7.5 is preferred as the range for the initial growth conditions. The fermentation may be conducted under aerobic or anaerobic conditions, wherein microaerobic conditions are preferred.

Typically, accumulation of high levels of PUFAs in oleaginous yeast cells requires a two-stage process, since the metabolic state must be "balanced" between growth and synthesis/storage of fats. Thus, most preferably, a two-stage fermentation process is necessary for the production of EPA in *Yarrowia lipolytica*. This approach is described in U.S. Pat. No. 7,238,482, as are various suitable fermentation process designs (i.e., batch, fed-batch and continuous) and considerations during growth.

In some aspects herein, the primary product is oleaginous yeast biomass. As such, isolation and purification of the EPA-containing oils from the biomass may not be necessary (i.e., wherein the whole cell biomass is the product).

However, certain end uses and/or product forms may require partial and/or complete isolation/purification of the EPA-containing oil from the biomass, to result in partially purified biomass, purified oil, and/or purified EPA. PUFAs, including EPA, may be found in the host microorganism (e.g., *Yarrowia*) as free fatty acids or in esterified forms such as acylglycerols, phospholipids, sulfolipids or glycolipids. These fatty acids may be extracted from the host cell through a variety of means well-known in the art. One review of extraction techniques, quality analysis and acceptability standards for yeast lipids is that of Z. Jacobs (*Critical Reviews in Biotechnology*, 12(5/6):463-491 (1992)). A brief review of downstream processing is also available by A. Singh and O. Ward (*Adv. Appl. Microbiol.*, 45:271-312 (1997)).

In general, means for the purification of EPA and other PUFAs from *Yarrowia* biomass may include extraction (e.g., U.S. Pat. No. 6,797,303 and U.S. Pat. No. 5,648,564) with organic solvents, sonication, supercritical fluid extraction (e.g., using carbon dioxide), saponification and physical means such as presses, bead beaters, or combinations thereof. One is referred to the teachings of U.S. Pat. No. 7,238,482 for additional details.

Oils containing EPA that have been refined and/or purified can be hydrogenated, to thereby result in fats with various melting properties and textures. Many processed fats, including spreads, confectionary fats, hard butters, margarines, baking shortenings, etc., require varying degrees of solidity at room temperature and can only be produced through alteration of the source oil's physical properties. This is most commonly achieved through catalytic hydrogenation (see Intl. App. Pub. No. WO 2006/052870 for additional details and references).

Food products, infant formulas, functional foods, medical foods, medical nutritionals, dietary supplements, pharmaceutical compositions, animal feeds, and personal care products comprising oleaginous yeast biomass comprising EPA are provided herein. Similarly, also provided are food products, infant formulas, functional foods, medical foods, medical nutritionals, dietary supplements, pharmaceutical compositions, animal feeds, and personal care products comprising EPA or microbial oil comprising EPA isolated from the recombinant oleaginous yeast biomass.

One of skill in the art of processing and formulation will understand how the amount and composition of the biomass, partially purified biomass, purified oil, and/or purified EPA may be added to a particular product according to target species and/or end use. More specifically, an "effective" amount should be incorporated into a product formulation, although this amount will depend on the food or feed product, the diet that the product is intended to supplement or the medical condition that the medical food or medical nutritional is intended to correct or treat. Most desirably, the effective amount of EPA will be sufficient to provide the desirable health characteristics associated with ω-3/ω-6 PUFA consumption. Typically, the amount of EPA incorporated into the product takes into account losses associated with processing conditions, typical handling and storage conditions, the stability of EPA in the product, and the bioavailability/bioabsorption efficiency with the target species, to name a few.

One of skill in the art of processing and formulation will be familiar with processes to concentrate the oil produced from the recombinant *Yarrowia* production host cells described herein, to thereby increase the concentration of EPA in the total lipid fraction such that it comprises at least about 60%, at least about 70%, at least about 80% or even at least about 90% EPA. Means to blend the purified oils described herein with other purified fatty acids (e.g., LA, GLA, EDA, DGLA, ARA, DTA, DPAn-6, ALA, STA, ETrA, ETA, DPA and DHA), or oils containing alternate fatty acids in preferred concentrations, are also well known to one of skill in the art. These techniques readily permit the creation of an oil comprising a uniquely tailored fatty acid profile.

Personal Care Products: Within the context of personal care products, ω-3 fatty acids have particular application in skin formulations where they may be used to enhance the skin conditioning effect. The skilled person will understand how to provide an effective amount of the relevant ω-3 fatty acid(s) or oil comprising the same to a skin care composition. In addition to the PUFA oil or ω-3 fatty acid, the skin care composition may further comprise a cosmetically acceptable medium for skin care compositions, examples of which are described by Philippe et al. in U.S. Pat. No. 6,280,747. For example, the cosmetically acceptable medium may be an anhydrous composition containing a fatty substance in a proportion generally from about 10% to about 90% by weight relative to the total weight of the composition, where the fatty phase contains at least one liquid, solid or semi-solid fatty substance. The fatty substance includes, but is not limited to, oils, waxes, gums, and so-called pasty fatty substances. Alternatively, the compositions may be in the form of a stable dispersion such as a water-in-oil or oil-in-water emulsion. Additionally, the compositions may contain one or more conventional cosmetic or dermatological additives or adjuvants including, but not limited to, antioxidants, preserving agents, fillers, surfactants, UVA and/or UVB sunscreens, fragrances, thickeners, wetting agents, anionic or nonionic or amphoteric polymers, and dyes.

Foodstuffs: The market place currently supports a large variety of food and feed products, incorporating ω-3 and/or ω-6 fatty acids (particularly LA, GLA, ARA, EPA, DPA and DHA). It is contemplated that the yeast biomass, partially purified biomass, purified oil, and/or purified EPA described herein will function in food products to impart the health benefits of current formulations.

Food products will include, but not be limited to: food analogs, drinks, meat products, cereal products, baked foods, snack foods and dairy products.

Food analogs can be made using processes well known to those skilled in the art. There can be mentioned meat analogs, cheese analogs, milk analogs and the like. Meat analogs made from soybeans contain soy protein or tofu and other ingredients mixed together to simulate various kinds of meats. These meat alternatives are sold as frozen, canned or dried foods. Usually, they can be used the same way as the foods they replace. Examples of meat analogs include, but are not limited to: ham analogs, sausage analogs, bacon analogs, and the like.

Food analogs can be classified as imitation or substitutes depending on their functional and compositional characteristics. For example, an imitation cheese need only resemble the cheese it is designed to replace. However, a product can generally be called a substitute cheese only if it is nutritionally equivalent to the cheese it is replacing and meets the minimum compositional requirements for that cheese. Thus, substitute cheese will often have higher protein levels than imitation cheeses and be fortified with vitamins and minerals.

Milk analogs or nondairy food products include, but are not limited to: imitation milks and nondairy frozen desserts (e.g., those made from soybeans and/or soy protein products).

Meat products encompass a broad variety of products. In the United States "meat" includes "red meats" produced from cattle, hogs and sheep. In addition to the red meats there are poultry items which include chickens, turkeys, geese, guineas, ducks and the fish and shellfish. There is a wide assortment of seasoned and processed meat products: fresh, cured and fried, and cured and cooked. Sausages and hot dogs are examples of processed meat products. Thus, the term "meat products" as used herein includes, but is not limited to, processed meat products.

A cereal food product is a food product derived from the processing of a cereal grain. A cereal grain includes any plant from the grass family that yields an edible grain (seed). The most popular grains are barley, corn, millet, oats, quinoa, rice, rye, sorghum, triticale, wheat and wild rice. Examples of cereal food products include, but are not limited to: whole grain, crushed grain, grits, flour, bran, germ, breakfast cereals, extruded foods, pastas, and the like.

A baked goods product comprises any of the cereal food products mentioned above and which has been baked or processed in a manner comparable to baking, i.e., to dry or harden by subjecting to heat. Examples of a baked good product include, but are not limited to: bread, cakes, doughnuts, bars, pastas, bread crumbs, baked snacks, mini-biscuits, mini-crackers, mini-cookies, and mini-pretzels. As was mentioned above, oils from the recombinant EPA production host cells can be used as an ingredient.

A snack food product comprises any of the above or below described food products.

A fried food product comprises any of the above or below described food products that has been fried.

The beverage can be in a liquid or in a dry powdered form. For example, there can be mentioned: non-carbonated drinks; fruit juices, fresh, frozen, canned or concentrate; flavored or plain milk drinks, etc. Adult and infant nutritional formulas are well known in the art and commercially available (e.g., Similac®, Ensure®, Jevity®, and Alimentum® from Ross Products Division, Abbott Laboratories).

A dairy product is a product derived from milk. A milk analog or nondairy product is derived from a source other than milk, for example, soymilk as was discussed above. These products include, but are not limited to: whole milk, skim milk, fermented milk products such as yoghurt or sour milk, cream, butter, condensed milk, dehydrated milk, coffee whitener, coffee creamer, ice cream, cheese, etc.

Additional food products into which the *Yarrowia* biomass, partially purified biomass, purified oil, and/or purified EPA could be included are, for example: chewing gums, confections and frostings, gelatins and puddings, hard and soft candies, jams and jellies, white granulated sugar, sugar substitutes, sweet sauces, toppings and syrups, and dry-blended powder mixes.

Infant Formulas: Infant formulas are liquids or reconstituted powders fed to infants and young children. "Infant formula" is defined herein as an enteral nutritional product which can be substituted for human breast milk in feeding infants and typically is composed of a desired percentage of fat mixed with desired percentages of carbohydrates and proteins in an aqueous solution (e.g., see U.S. Pat. No. 4,670, 285). Based on worldwide composition studies, as well as levels specified by expert groups, average human breast milk typically contains about 0.20% to 0.40% of total fatty acids (assuming about 50% of calories from fat); and, generally the ratio of DHA to ARA would range from about 1:1 to 1:2 (see, e.g., formulations of Enfamil LIPIL™ [Mead Johnson & Company] and Similac Advance™ [Ross Products Division, Abbott Laboratories]). Infant formulas have a special role to play in the diets of infants because they are often the only source of nutrients for infants. Although breast-feeding is still the best nourishment for infants, infant formula is a close enough second that babies not only survive but thrive.

Health Food Products And Pharmaceuticals: The present biomass, partially purified biomass, purified oil, and/or purified EPA may be used in formulations to impart health benefit in health food products, including functional foods, medical foods, medical nutritionals and dietary supplements. Additionally, Yarrowia biomass, partially purified biomass, purified oil, and/or purified EPA may be used in standard pharmaceutical compositions. The present engineered strains of Yarrowia lipolytica or the microbial oils produced therefrom comprising EPA could readily be incorporated into the any of the above mentioned food products, to thereby produce e.g., a functional or medical food. For example, more concentrated formulations comprising EPA include capsules, powders, tablets, softgels, gelcaps, liquid concentrates and emulsions which can be used as a dietary supplement in humans or animals other than humans.

Animal Feed Products: Animal feeds are generically defined herein as products intended for use as feed or for mixing in feed for animals other than humans. The Yarrowia biomass, partially purified biomass, purified oil, and/or purified EPA described herein can be used as an ingredient in various animal feeds.

More specifically, although not to be construed as limiting, it is expected that the EPA products from the recombinant Yarrowia host cells can be used within pet food products, ruminant and poultry food products and aquacultural food products. Pet food products are those products intended to be fed to a pet, such as a dog, cat, bird, reptile, rodent. These products can include the cereal and health food products above, as well as meat and meat byproducts, soy protein products, grass and hay products (such as alfalfa, timothy, oat or brome grass) and vegetables. Ruminant and poultry food products are those wherein the product is intended to be fed to e.g., turkeys, chickens, cattle and swine. As with the pet foods above, these products can include cereal and health food products, soy protein products, meat and meat byproducts, and grass and hay products as listed above. Aquacultural food products (or "aquafeeds") are those products intended to be used in aquafarming, which concerns the propagation, cultivation or farming of aquatic organisms and/or animals in fresh or marine waters.

It is contemplated that the present engineered strains of Yarrowia lipolytica that are producing high concentrations of EPA will be especially useful to include in most animal feed formulations. In addition to providing necessary ω-3 PUFAs, the yeast itself is a useful source of protein and other nutrients (e.g., vitamins, minerals, nucleic acids, complex carbohydrates, etc.) that can contribute to overall animal health and nutrition, as well as increase a formulation's palatablility. Accordingly it is contemplated that the addition of yeast biomass comprising the recombinant Yarrowia production hosts will be an excellent additional source of feed nutrients in animal feed formulations (see U.S. Pat. Appl. Pub. No. 2009-0093543-A1 for additional details).

It is clear then that the present engineered strains of Yarrowia lipolytica that are producing high concentrations of EPA will be especially useful to include in most aquaculture feeds. In addition to providing necessary ω-3 and/or ω-6 PUFAs, the yeast itself is a useful source of protein that can increase the formulation's palatablility. In alternate embodiments, the oils produced by the present strains of Y. lipolytica could be introduced directly into the aquaculture feed formulations, following extraction and purification from the cell mass.

There is increasing awareness that EPA is an important ω-3 fatty acid in and of itself. As a result, it is expected herein that the EPA-enriched oils of the recombinant Yarrowia production hosts described herein will have very broad utility in a variety of therapeutic applications, e.g., inflammation, cardiovascular diseases, nutrient regulation of gene expression and dyslipidemia, and specifically in the treatment of clinical conditions including: coronary heart disease, high blood pressure, inflammatory disorders, Type II diabetes, ulcerative colitis, Crohn's disease, anorexia nervosa, burns, osteoarthritis, osteoporosis, depression, and attention deficit/hyperactivity disorder.

U.S. Pat. Appl. Pub. No. 2009-0093543-A1 describes additional clinical human studies, relating to EPA and inflammation, EPA and cardiovascular diseases, ω-3 PUFAs and nutrient regulation of gene expression, and ω-3 PUFAs and dyslipidemia and should be referred to therein. More recently, a randomized, double-blind placebo-controlled study was performed in 110 normal healthy subject, wherein subjects were provided one of the following for 6 weeks, as a means to evaluate the effects of the oils on cardiovascular disease risk factors, adverse events and safety parameters: 600 mg/day EPA, 1800 mg/day EPA, 600 mg/day DHA or olive oil (placebo) (Gillies, P., "The New Science of Omega-3 Fatty Acids: Differential Nutritional Pharmacology" Texas Human Nutrition Conference, Texas A&M University, February 2010; U.S. Provisional Patent Applications No. 61/292,915 [filed Jan. 7, 2010] and No 61/295,347 filed Jan. 15, 2010], having E. I duPont de Nemours and Company). The 600 mg EPA per day supplement was found to maintain healthy cholesterol levels already in the normal range. Notably, the EPA oils of the study were derived from engineered strains of Yarrowa lipolytica.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions.

General Methods

Standard recombinant DNA and molecular cloning techniques used in the Examples are well known in the art and are described by: 1) Sambrook, J., Fritsch, E. F. and Maniatis, T. Molecular Cloning: A Laboratory Manual; Cold Spring Harbor Laboratory: Cold Spring Harbor, N.Y. (1989) (Maniatis); 2) T. J. Silhavy, M. L. Bennan, and L. W. Enquist, Experiments with Gene Fusions; Cold Spring Harbor Laboratory: Cold Spring Harbor, N.Y. (1984); and, 3) Ausubel, F. M. et al., Current Protocols in Molecular Biology, published by Greene Publishing Assoc. and Wiley-Interscience, Hoboken, N.J. (1987).

Materials and Methods suitable for the maintenance and growth of microbial cultures are well known in the art. Techniques suitable for use in the following examples may be found as set out in Manual of Methods for General Bacteriology (Phillipp Gerhardt, R. G. E. Murray, Ralph N. Costilow, Eugene W. Nester, Willis A. Wood, Noel R. Krieg and G. Briggs Phillips, Eds), American Society for Microbiology: Washington, D.C. (1994)); or by Thomas D. Brock in Biotechnology: A Textbook of Industrial Microbiology, 2nd ed., Sinauer Associates: Sunderland, Mass. (1989). All reagents, restriction enzymes and materials used for the growth and maintenance of microbial cells were obtained from Aldrich Chemicals (Milwaukee, Wis.), DIFCO Laboratories (Detroit, Mich.), New England Biolabs, Inc. (Beverly, Mass.), GIBCO/BRL (Gaithersburg, Md.), or Sigma Chemical Company (St. Louis, Mo.), unless otherwise specified. E. coli strains were typically grown at 37° C. on Luria Bertani ["LB"] plates.

General molecular cloning was performed according to standard methods (Sambrook et al., supra). When PCR or site-directed mutagenesis was involved in subcloning, the constructs were sequenced to confirm that no errors had been introduced to the sequence. PCR products were cloned into Promega's pGEM-T-easy vector (Madison, Wis.).

The meaning of abbreviations is as follows: "sec" means second(s), "min" means minute(s), "h" means hour(s), "d" means day(s), "µL" means microliter(s), "mL" means milliliter(s), "L" means liter(s), "µM" means micromolar, "mM" means millimolar, "M" means molar, "mmol" means millimole(s), "µmole" mean micromole(s), "g" means gram(s), "µg" means microgram(s), "ng" means nanogram(s), "U" means unit(s), "bp" means base pair(s), "kB" means kilobase(s), "DCW" means dry cell weight, and "TFAs" means total fatty acids.

Nomenclature for Expression Cassettes

The structure of an expression cassette will be represented by a simple notation system of "X::Y::Z", wherein X describes the promoter fragment, Y describes the gene fragment, and Z describes the terminator fragment, which are all operably linked to one another.

Transformation and Cultivation of Yarrowia lipolytica

Yarrowia lipolytica strain ATCC #20362 was purchased from the American Type Culture Collection (Rockville, Md.). Yarrowia lipolytica strains were routinely grown at 28-30° C. in several media, according to the recipes shown below. Agar plates were prepared as required by addition of 20 g/L agar to each liquid media, according to standard methodology.

YPD agar medium (per liter): 10 g of yeast extract [Difco], 20 g of Bacto peptone [Difco], and 20 g of glucose.

Basic Minimal Media ["MM"] (per liter): 20 g glucose, 1.7 g yeast nitrogen base without amino acids, 1.0 g proline, and pH 6.1 (do not need to adjust).

Minimal Media+Uracil ["MM+uracil or MMU"] (per liter): Prepare MM media as above and add 0.1 g uracil and 0.1 g uridine.

Minimal Media+Uracil+Sulfonylurea ["MMU+SU"] (per liter): Prepare MMU media as above and add 280 mg sulfonylurea.

Minimal Media+Uracil+Lysine ["MMUraLys"] (per liter): Prepare MM media as above and add 0.1 g uracil, 0.1 g uridine. and 0.1 g lysine.

Minimal Media+5-Fluoroorotic Acid ["MM+5-FOA"] (per liter): 20 g glucose, 6.7 g Yeast Nitrogen base, 75 mg uracil, 75 mg uridine and appropriate amount of FOA (Zymo Research Corp., Orange, Calif.), based on FOA activity testing against a range of concentrations from 100 mg/L to 1000 mg/L (since variation occurs within each batch received from the supplier).

High Glucose Media ["HGM"] (per liter): 80 glucose, 2.58 g $KH_2PO_4$ and 5.36 g $K_2HPO_4$, pH 7.5 (do not need to adjust).

Fermentation medium without Yeast Extract ["FM without YE"] (per liter): 6.70 g/L Yeast nitrogen base, 6.00 g $KH_2PO_4$, 2.00 g $K_2HPO_4$, 1.50 g $MgSO_4.7H_2O$, and 20 g glucose.

Fermentation medium ["FM"] (per liter): 6.70 g/L Yeast nitrogen base, 6.00 g $KH_2PO_4$, 2.00 g $K_2HPO_4$, 1.50 g $MgSO_4.7H_2O$, 20 g glucose and 5.00 g Yeast extract (BBL).

Transformation of Y. lipolytica was performed as described in U.S. Pat. Appl. Pub. No. 2009-0093543-A1, hereby incorporated herein by reference.

Fatty Acid Analysis of Yarrowia lipolytica

For fatty acid ["FA"] analysis, cells were collected by centrifugation and lipids were extracted as described in Bligh, E. G. & Dyer, W. J. (Can. J. Biochem. Physiol., 37:911-917 (1959)). Fatty acid methyl esters ["FAMEs"] were prepared by transesterification of the lipid extract with sodium methoxide (Roughan, G., and Nishida I., Arch Biochem Biophys., 276(1):38-46 (1990)) and subsequently analyzed with a Hewlett-Packard 6890 GC fitted with a 30-m×0.25 mm (i.d.) HP-INNOWAX (Hewlett-Packard) column. The oven temperature was from 170° C. (25 min hold) to 185° C. at 3.5° C./min.

For direct base transesterification, Yarrowia cells (0.5 mL culture) were harvested, washed once in distilled water, and dried under vacuum in a Speed-Vac for 5-10 min. Sodium methoxide (100 µl of 1%) and a known amount of C15:0 triacylglycerol (C15:0 TAG; Cat. No. T-145, Nu-Check Prep, Elysian, Minn.) was added to the sample, and then the sample was vortexed and rocked for 30 min at 50° C. After adding 3 drops of 1 M NaCl and 400 µl hexane, the sample was vortexed and spun. The upper layer was removed and analyzed by GC.

FAME peaks recorded via GC analysis were identified by their retention times, when compared to that of known fatty acids, and quantitated by comparing the FAME peak areas with that of the internal standard (C15:0 TAG) of known amount. Thus, the approximate amount (µg) of any fatty acid FAME ["µg FAME"] is calculated according to the formula: (area of the FAME peak for the specified fatty acid/area of the standard FAME peak)*(µg of the standard C15:0 TAG), while the amount (µg) of any fatty acid ["µg FA"] is calculated according to the formula: (area of the FAME peak for the specified fatty acid/area of the standard FAME peak)*(µg of the standard C15:0 TAG)*0.9503, since 1 µg of C15:0 TAG is equal to 0.9503 µg fatty acids. Note that the 0.9503 conversion factor is an approximation of the value determined for most fatty acids, which range between 0.95 and 0.96.

The lipid profile, summarizing the amount of each individual fatty acid as a weight percent of TFAs, was determined by dividing the individual FAME peak area by the sum of all FAME peak areas and multiplying by 100.

Analysis of Total Lipid Content and Composition in Yarrowia lipolytica by Flask Assay For a detailed analysis of the total lipid content and composition in a particular strain of Y. lipolytica, flask assays were conducted as followed. Specifically, one loop of freshly streaked cells was inoculated into 3 mL FM medium and grown overnight at 250 rpm and 30° C. The $OD_{600nm}$ was measured and an aliquot of the cells were added to a final $OD_{600nm}$ of 0.3 in 25 mL FM medium in a 125 mL flask. After 2 days in a shaker incubator at 250 rpm and at 30° C., 6 mL of the culture was harvested by centrifugation and resuspended in 25 mL HGM in a 125 mL flask. After 5 days in a shaker incubator at 250 rpm and at 30° C., a 1 mL aliquot was used for fatty acid analysis (supra) and 10 mL dried for dry cell weight ["DCW"] determination.

For DCW determination, 10 mL culture was harvested by centrifugation for 5 min at 4000 rpm in a Beckman GH-3.8 rotor in a Beckman GS-6R centrifuge. The pellet was resuspended in 25 mL of water and re-harvested as above. The washed pellet was re-suspended in 20 mL of water and transferred to a pre-weighed aluminum pan. The cell suspension was dried overnight in a vacuum oven at 80° C. The weight of the cells was determined.

Total lipid content of cells ["TFAs % DCW"] is calculated and considered in conjunction with data tabulating the concentration of each fatty acid as a weight percent of TFAs ["% TFAs"] and the EPA content as a percent of the dry cell weight ["EPA % DCW"]. Data from flask assays will be presented as a table that summarizes the total dry cell weight of the cells ["DCW"], the total lipid content of cells ["TFAs % DCW"], the concentration of each fatty acid as a weight percent of TFAs ["% TFAs"] and the EPA content as a percent of the dry cell weight ["EPA % DCW"]. More specifically, fatty acids will be identified as 16:0 (palmitate), 16:1 (palmitoleic acid), 18:0 (stearic acid), 18:1 (oleic acid), 18:2 (LA), ALA, EDA, DGLA, ARA, ETrA, ETA, EPA and other.

Example 1

Generation of *Yarrowia lipolytica* Strain L135 (Ura3+, Leu–, Δpex3) to Produce About 46% DGLA of Total Fatty Acids The present Example describes the construction of strain L135, derived from *Yarrowia lipolytica* ATCC #20362, capable of producing about 46% DGLA relative to the total lipids via expression of a Δ9 elongase/Δ8 desaturase pathway.

Briefly, as diagrammed in FIG. 2, strain L135 was derived from *Yarrowia lipolytica* ATCC #20362 via construction of strain Y2224 (a FOA resistant mutant from an autonomous mutation of the Ura3 gene of wildtype *Yarrowia* strain ATCC #20362), strain Y4001 (producing 17% EDA with a Leu– phenotype), strain Y4001U1 (Leu– and Ura–), strain Y4036 (producing 18% DGLA with a Leu– phenotype) and strain Y4036U (Leu– and Ura–). Further details regarding the construction of strains Y2224, Y4001, Y4001U, Y4036 and Y4036U are described in the General Methods of U.S. Pat. App. Pub. No. 2008-0254191, hereby incorporated herein by reference.

The final genotype of strain Y4036U with respect to wild type *Yarrowia lipolytica* ATCC #20362 was Ura3–, YAT1::ME3S::Pex16, EXP1::EgD9eS::Lip1, FBAINm::EgD9eS::Lip2, GPAT::EgD9e::Lip2, FBAINm::EgD8M::Pex20, EXP1::EgD8M::Pex16, GPD::FmD12::Pex20, YAT1::FmD12::OCT (wherein FmD12 is a *Fusarium moniliforme* Δ12 desaturase gene [U.S. Pat. No. 7,504,259]; ME3S is a codon-optimized $C_{16/18}$ elongase gene, derived from *Mortierella alpina* [U.S. Pat. No. 7,470,532]; EgD9e is a *Euglena gracilis* Δ9 elongase gene [U.S. Pat. No. 7,645,604]; EgD9eS is a codon-optimized Δ9 elongase gene, derived from *Euglena gracilis* [U.S. Pat. No. 7,645,604]; EgD8M is a synthetic mutant Δ8 desaturase [U.S. Pat. No. 7,709,239], derived from *Euglena gracilis* [U.S. Pat. No. 7,256,033]).

Generation of L135 Strain with Chromosomal Deletion of Pex3

Construction of strain L135 is described in Example 12 of Intl. App. Pub. No. WO 2009/046248, hereby incorporated herein by reference. Briefly, construct pY157 was used to knock out the chromosomal gene encoding the peroxisome biogenesis factor 3 protein [peroxisomal assembly protein Peroxin 3 or "Pex3p"] in strain Y4036U, thereby producing strain L135 (also referred to as strain Y4036 (Δpex3)). Knockout of the chromosomal Pex3 gene in strain L135, as compared to in strain Y4036 (whose native Pex3p had not been knocked out) resulted in the following: higher lipid content (TFAs % DCW) (ca. 6.0% versus 4.7%), higher DGLA % TFAs (46% versus 19%), higher DGLA % DCW (ca. 2.8% versus 0.9%) and reduced LA % TFAs (12% versus 30%). Additionally, the Δ9 elongase percent conversion efficiency was increased from ca. 48% in strain Y4036 to 83% in strain L135.

The final genotype of strain L135 with respect to wildtype *Yarrowia lipolytica* ATCC #20362 was Ura3+, Leu–, Pex3–, unknown1–, YAT1::ME3S::Pex16, EXP1::EgD9eS::Lip1, FBAINm::EgD9eS::Lip2, GPAT::EgD9e::Lip2, FBAINm::EgD8M::Pex20, EXP1::EgD8M::Pex16, GPD::FmD12::Pex20, YAT1::FmD12::OCT.

Example 2

Generation of *Yarrowia lipolytica* Strains Producing from About 18% to About 41% ARA of Total Fatty Acids ["TFAs"]

The present Example describes the construction of strain Y8006, derived from *Yarrowia lipolytica* ATCC #20362, capable of producing about 41% ARA relative to the total lipids via expression of a Δ9 elongase/Δ8 desaturase pathway.

The development of strain Y8006 (FIG. 2) required the construction of strains Y2224, Y4001, Y4001U, Y4036, Y4036U and L135 (described in Example 1), as well as construction of strains L135U9 and Y8002.

Generation of L135U9 (Leu–, Ura3–) Strain

Strain L135U was created via temporary expression of the Cre recombinase enzyme in plasmid pY116 (FIG. 3; SEQ ID NO:127; described in Example 7 of Intl. App. Pub. No. WO 2008/073367, hereby incorporated herein by reference) within strain L135 to produce a Leu– and Ura– phenotype. Plasmid pY116 was used for transformation of freshly grown L135 cells according to the General Methods. The transformant cells were plated onto MMLeuUra and maintained at 30° C. for 3 to 4 days. Three colonies were picked, inoculated into 3 mL liquid YPD media at 30° C. and shaken at 250 rpm/min for 1 day. The cultures were diluted to 1:50,000 with liquid MMLeuUra media, and 100 μL was plated onto new YPD plates and maintained at 30° C. for 2 days. Eight colonies were picked from each of three plates (24 colonies total) and streaked onto MMLeu and MMLeuUra selection plates. The colonies that could grow on MMLeuUra plates but not on MMLeu plates were selected and analyzed by GC to confirm the presence of C20:2 (EDA). One strain, having a Leu– and Ura– phenotype, was designated as L135U9.

Generation of Y8002 Strain to Produce About 32% ARA of TFAs

Figure 4A:
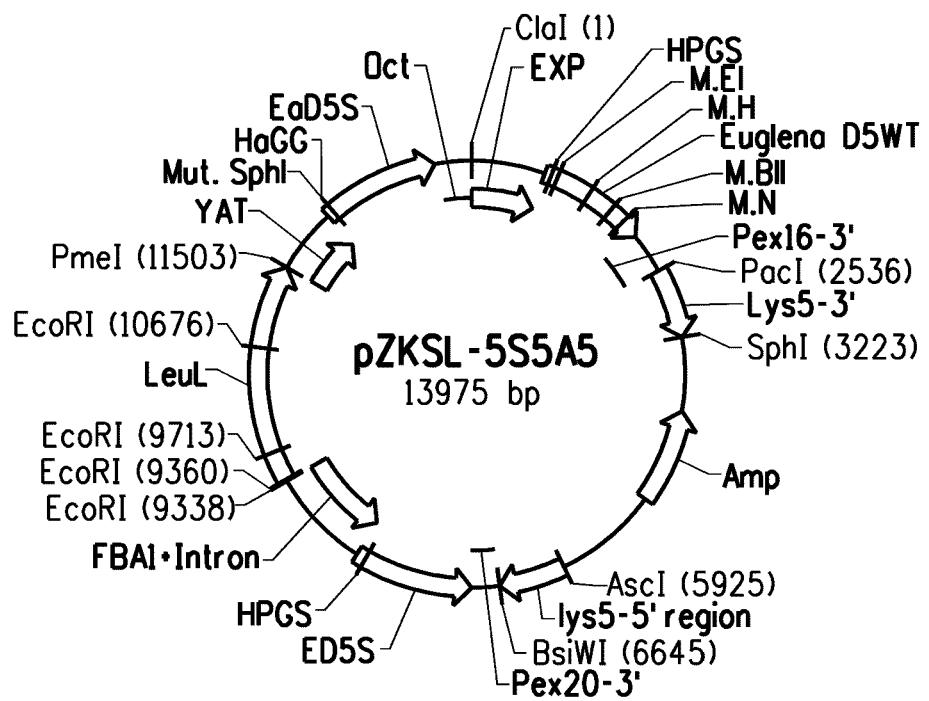

Construct pZKSL-555A5 (FIG. 4A; SEQ ID NO:128) was generated to integrate three Δ5 desaturase genes into the Lys loci of strain L135U9, to thereby enable production of ARA. The pZKSL-555A5 plasmid contained the following components:

TABLE 6

Description of Plasmid pZKSL-5S5A5 (SEQ ID NO: 128)

| RE Sites And Nucleotides Within SEQ ID NO: 128 | Description Of Fragment And Chimeric Gene Components |
|---|---|
| AscI/BsiWI (5925-6645) | 720 by 5' portion of *Yarrowia* Lys5 gene (GenBank Accession No. M34929; labeled as "lys5 5' region" in Figure) |
| PacI/SphI (2536-3225) | 689 by 3' portion of *Yarrowia* Lys5 gene (GenBank Accession No. M34929; labeled as "Lys5-3'" in Figure) |
| EcoRI/BsiWI (9338-6645) | FBAIN::EgD5SM::Pex20, comprising: FBAIN: *Yarrowia lipolytica* FBAIN promoter (U.S. Pat. No. 7,202,356); EgD5SM: Synthetic mutant Δ5 desaturase (SEQ ID NO: 71; U.S. Pat. Pub. No. 2010-0075386-A1), derived from *Euglena gracilis* (U.S. Pat. No. 7,678,560) (labeled as "ED5S" in Figure); Pex20: Pex20 terminator sequence from *Yarrowia* Pex20 gene (GenBank Accession No. AF054613) |
| PmeI/ClaI (11503-1) | YAT1::EaD5SM::OCT, comprising: YAT1: *Yarrowia lipolytica* YAT1 promoter (labeled as "YAT" in Figure; U.S. Pat. Appl. Pub. No. 2006-0094102-A1); EaD5SM: Synthetic mutant Δ5 desaturase (SEQ ID NO: 81; U.S. Pat. Pub. No. 2010-0075386-A1), derived from *Euglena anabaena* (U.S. Pat. Appl. Pub. No. 2008-0274521-A1) (labeled as "EaD5S" in Figure); OCT: OCT terminator sequence of *Yarrowia* OCT gene (GenBank Accession No. X69988) |
| ClaI/PacI (1-2536) | EXP1::EgD5M::Pex16, comprising: EXP1: *Yarrowia lipolytica* export protein (EXP1) promoter (labeled as "EXP" in Figure; Intl. App. Pub. No. WO 2006/052870); EgD5M: Mutant Δ5 desaturase (SEQ ID NO: 69; U.S. Pat. Pub. No. 2010-0075386-A1) with elimination of internal EcoRI, BglII, HindIII and NcoI restriction enzyme sites, derived from *Euglena gracilis* (U.S. Pat. No. 7,678,560) (labeled as "*Euglena* D5WT" in Figure); Pex16: Pex16 terminator sequence from *Yarrowia* Pex16 gene (GenBank Accession No. U75433) |
| EcoRI/PmeI (9360-11503) | *Yarrowia* Leu2 gene (GenBank Accession No. M37309) |

The pZKSL-5S5A5 plasmid was digested with AscI/SphI, and then used for transformation of strain L135U9 according to the General Methods. The transformant cells were plated onto MMUraLys plates and maintained at 30° C. for 2 to 3 days. Single colonies were then re-streaked onto MMUraLys plates, and then inoculated into liquid MMUraLys at 30° C. and shaken at 250 rpm/min for 2 days. The cells were subjected to fatty acid analysis, according to the General Methods.

GC analyses showed the presence of ARA in the transformants containing the 3 chimeric genes of pZKSL-555A5, but not in the parent L135U9 strain. Five strains (i.e., #28, #62, #73, #84 and #95) that produced about 32.2%, 32.9%, 34.4%, 32.1% and 38.6% ARA of TFAs were designated as strains Y8000, Y8001, Y8002, Y8003 and Y8004, respectively. Further analyses showed that the three chimeric genes of pZKSL-5S5A5 were not integrated into the Lys5 site in the Y8000, Y8001, Y8002, Y8003 and Y8004 strains. All strains possessed a Lys+ phenotype.

The final genotype of strains Y8000, Y8001, Y8002, Y8003 and Y8004 with respect to wildtype *Yarrowia lipolytica* ATCC #20362 was Ura–, Pex3–, unknown 1-, unknown 2-, Leu+, Lys+, YAT1::ME3S::Pex16, GPD::FmD12::Pex20, YAT1::FmD12::Oct, GPAT::EgD9e::Lip2, FBAINm::EgD9eS::Lip2, EXP1::EgD9eS::Lip1, FBAINm::EgD8M::Pex20, EXP1::EgD8M::Pex16, FBAIN::EgD5SM::Pex20, EXP1::EgD5M::Pex16, YAT1::EaD5SM::Oct.

Generation of Y8006 Strain to Produce About 41% ARA of TFAs

Figure 4B:
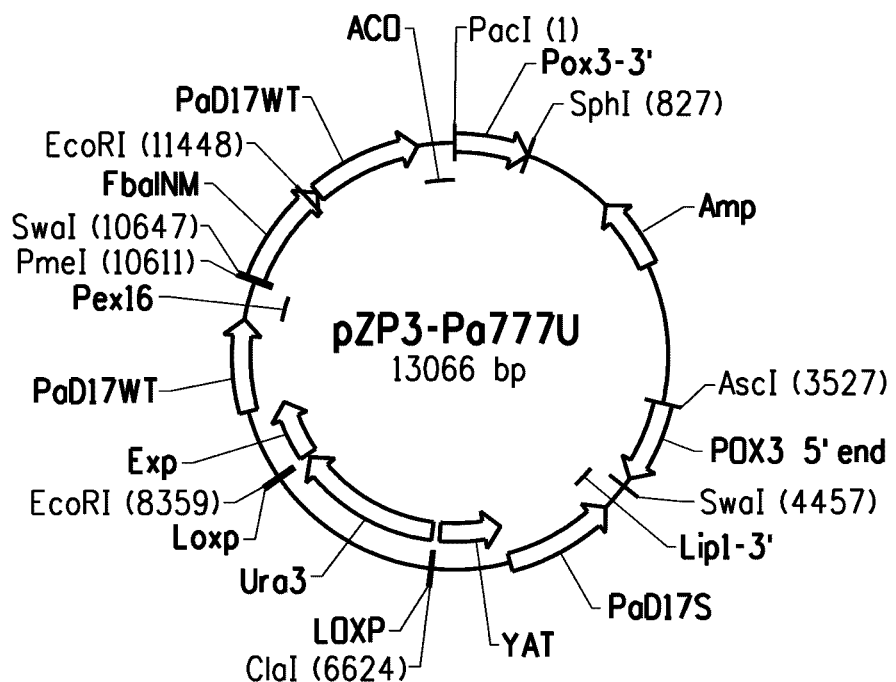

Construct pZP3-Pa777U (FIG. 4B; SEQ ID NO:129; described in Table 9 of U.S. Pat. Appl. Pub. No. 2009-0093543-A1, hereby incorporated herein by reference) was generated to integrate three Δ17 desaturase genes into the Pox3 loci (GenBank Accession No. AJ001301) of strain Y8002.

The pZP3-Pa777U plasmid was digested with AscI/SphI, and then used for transformation of strain Y8002 according to the General Methods. The transformant cells were plated onto MM plates and maintained at 30° C. for 2 to 3 days. Single colonies were then re-streaked onto MM plates, and then inoculated into liquid MM at 30° C. and shaken at 250 rpm/min for 2 days. The cells were subjected to fatty acid analysis, according to the General Methods.

GC analyses showed the presence of 26% to 31% EPA of TFAs in most of the selected 96 transformants containing the 3 chimeric genes of pZP3-Pa777U, but not in the parent Y8002 strain. Strain #69 produced about 38% EPA of TFAs and was designated as Y8007. There was one strain (i.e., strain #9) that did not produce EPA, but produced about 41% ARA of TFAs. This strain was designated as Y8006. Based on the lack of EPA production in strain Y8006, its genotype with respect to wildtype *Yarrowia lipolytica* ATCC #20362 is assumed to be Pex3–, unknown 1-, unknown 2-, unknown 3-, Leu+, Lys+, Ura+, YAT1::ME3S::Pex16, GPD::FmD12::

Pex20, YAT1::FmD12::Oct, GPAT::EgD9e::Lip2, FBAINm::EgD9eS::Lip2, EXP1::EgD9eS::Lip1, FBAINm::EgD8M::Pex20, EXP1::EgD8M::Pex16, FBAIN::EgD5SM::Pex20, EXP1::EgD5M::Pex16, YAT1::EaD5SM::Oct.

In contrast, the final genotype of strain Y8007 with respect to wildtype *Yarrowia lipolytica* ATCC #20362 was Pex3−, unknown 1−, unknown 2−, unknown 3−, Leu+, Lys+, Ura+, YAT1::ME3S::Pex16, GPD::FmD12::Pex20, YAT1::FmD12::Oct, GPAT::EgD9e::Lip2, FBAINm::EgD9eS::Lip2, EXP1::EgD9eS::Lip1, FBAINm::EgD8M::Pex20, EXP1::EgD8M::Pex16, FBAIN::EgD5SM::Pex20, EXP1::EgD5M::Pex16, YAT1::EaD5SM::Oct, YAT1::PaD17S::Lip1, EXP1::PaD17::Pex16, FBAINm::PaD17::Aco (wherein PaD17 is a *Pythium aphanidermatum* Δ17 desaturase [U.S. Pat. No. 7,556,949] and PaD17S is a codon-optimized Δ17 desaturase, derived from *Pythium aphanidermatum* [U.S. Pat. No. 7,556,949].

Integration of the 3 chimeric genes of pZP3-Pa777U into the Pox3 loci (GenBank Accession No. AJ001301) in strains Y8006 and Y8007 was not confirmed.

Example 3

Generation of *Yarrowia lipolytica* Strains Producing from About 24% to About 56% EPA of Total Fatty Acids ["TFAs"]

The present Example describes the construction of strain Y8412, derived from *Yarrowia lipolytica* ATCC #20362, capable of producing about 56% EPA relative to the total lipids via expression of a Δ9 elongase/Δ8 desaturase pathway.

The development of strain Y8412 (FIG. 2) required the construction of strains Y2224, Y4001, Y4001U, Y4036, Y4036U and L135 (described in Example 1), strains L135U9 and Y8002 (described in Example 2), and strains Y8006U6, Y8069, Y8069U, Y8154, Y8154U, Y8269 and Y8269U.

Generation of Strain Y8006U6 (Ura3−)

Figure 5A:
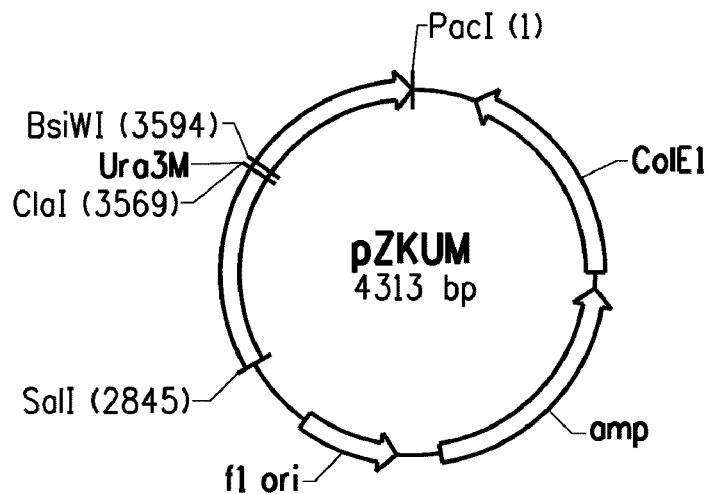

In order to disrupt the Ura3 gene, construct pZKUM (FIG. 5A; SEQ ID NO:130; described in Table 15 of U.S. Pat. Appl. Pub. No. 2009-0093543-A1, hereby incorporated herein by reference) was used to integrate a Ura3 mutant gene into the Ura3 gene of strain Y8006.

Plasmid pZKUM was digested with SalI/PacI, and then used to transform strain Y8006 according to the General Methods. Following transformation, cells were plated onto MM+5-FOA selection plates and maintained at 30'C for 2 to 3 days.

A total of 8 transformants grown on MM+5-FOA plates were picked and re-streaked onto MM plates and MM+5-FOA plates, separately. All 8 strains had a Ura− phenotype (i.e., cells could grow on MM+5-FOA plates, but not on MM plates). The cells were scraped from the MM+5-FOA plates and subjected to fatty acid analysis, according to the General Methods.

GC analyses showed the presence of 22.9%, 25.5%, 23.6% 21.6%, 21.6% and 25% ARA in the pZKUM-transformant strains #1, #2, #4, #5, #6 and #7, respectively, grown on MM+5-FOA plates. These six strains were designated as strains Y8006U1, Y8006U2, Y8006U3, Y8006U4, Y8006U5 and Y8006U6, respectively (collectively, Y8006U).

Generation of Y8069 Strain to Produce About 37.5% EPA of TFAs

Construct pZP3-Pa777U (FIG. 4B; SEQ ID NO:129; described in Table 9 of U.S. Pat. Appl. Pub. No. 2009-0093543-A1, hereby incorporated herein by reference) was used to integrate three Δ17 desaturase genes into the Pox3 loci (GenBank Accession No. AJ001301) of strain Y8006U6.

The pZP3-Pa777U plasmid was digested with AscI/SphI, and then used for transformation of strain Y8006U6 according to the General Methods. The transformant cells were plated onto MM plates and maintained at 30° C. for 2 to 3 days. Single colonies were then re-streaked onto MM plates, and then inoculated into liquid MM at 30° C. and shaken at 250 rpm/min for 2 days. The cells were subjected to fatty acid analysis, according to the General Methods.

GC analyses showed the presence of EPA in the transformants containing the 3 chimeric genes of pZP3-Pa777U, but not in the parent Y8006U6 strain. Most of the selected 24 strains produced 24-37% EPA of TFAs. Four strains (i.e., #1, #6, #11 and #14) that produced 37.5%, 43.7%, 37.9% and 37.5% EPA of TFAs were designated as Y8066, Y8067, Y8068 and Y8069, respectively. Integration of the 3 chimeric genes of pZP3-Pa777U into the Pox3 loci (GenBank Accession No. AJ001301) of strains Y8066, Y8067, Y8068 and Y8069 was not confirmed.

The final genotype of strains Y8066, Y8067, Y8068 and Y8069 with respect to wildtype *Yarrowia lipolytica* ATCC #20362 was Ura+, Pex3−, unknown 1−, unknown 2−, unknown 3−, unknown 4−, Leu+, Lys+, YAT1::ME3S::Pex16, GPD::FmD12::Pex20, YAT1::FmD12::Oct, GPAT::EgD9e::Lip2, FBAINm::EgD9eS::Lip2, EXP1::EgD9eS::Lip1, FBAINm::EgD8M::Pex20, EXP1::EgD8M::Pex16, FBAIN::EgD5SM::Pex20, EXP1::EgD5M::Pex16, YAT1::EaD5SM::Oct, YAT1::PaD17S::Lip1, EXP1::PaD17::Pex16, FBAINm::PaD17::Aco.

Generation of Strain Y8069U (Ura3−)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8069, in a manner similar to that described for pZKUM transformation of strain Y8006 (supra). A total of 3 transformants were grown and identified to possess a Ura− phenotype.

GC analyses showed the presence of 22.4%, 21.9% and 21.5% EPA in the pZKUM-transformant strains #1, #2 and #3, respectively, grown on MM+5-FOA plates. These three strains were designated as strains Y8069U1, Y8069U2, and Y8069U3, respectively (collectively, Y8069U).

Generation of Strain Y8154 to Produce about 44.8% EPA of TFAs

Figure 5B:
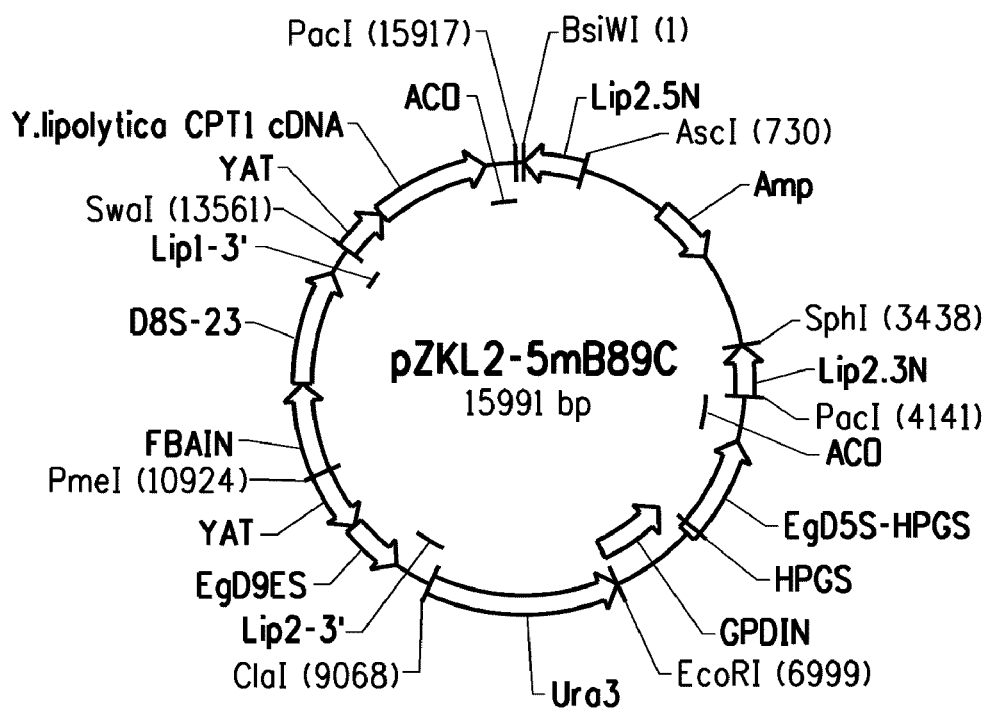

Construct pZKL2-5mB89C (FIG. 5B; SEQ ID NO:131) was generated to integrate one Δ5 desaturase gene, one Δ9 elongase gene, one Δ8 desaturase gene, and one *Yarrowia lipolytica* diacylglycerol cholinephosphotransferase gene (CPT1) into the Lip2 loci (GenBank Accession No. AJ012632) of strain Y8069U3 to thereby enable higher level production of EPA. The pZKL2-5mB89C plasmid contained the following components:

TABLE 7

Description of Plasmid pZKL2-5mB89C (SEQ ID NO: 131)

| RE Sites And Nucleotides Within SEQ ID NO: 131 | Description Of Fragment And Chimeric Gene Components |
|---|---|
| AscI/BsiWI (730-1) | 722 bp 5' portion of *Yarrowia* Lip2 gene (labeled as "Lip2.5N" in Figure; GenBank Accession No. AJ012632) |
| PacI/SphI (4141-3438) | 697 bp 3' portion of *Yarrowia* Lip2 gene (labeled as "Lip2.3N" in Figure; GenBank Accession No. AJ012632) |
| SwaI/BsiWI (13561-1) | YAT1::YICPT1::Aco, comprising:<br>YAT1: *Yarrowia lipolytica* YAT1 promoter (labeled as "YAT" in Figure; U.S. Pat. Appl. Pub. No. 2006-0094102-A1);<br>YICPT1: *Yarrowia lipolytica* diacylglycerol cholinephosphotransferase gene (SEQ ID NO: 37) (labeled as "*Y. lipolytica* CPT1 cDNA" in Figure; Intl. App. Pub. No. WO 2006/052870);<br>Aco: Aco terminator sequence from *Yarrowia* Aco gene (GenBank Accession No. AJ001300) |
| PmeI/SwaI (10924-13561) | FBAIN::EgD8M::Lip1 comprising:<br>FBAIN: *Yarrowia lipolytica* FBAIN promoter (U.S. Pat. No. 7,202,356);<br>EgD8M: Synthetic mutant Δ8 desaturase (SEQ ID NO: 59; U.S. Pat. No. 7,709,239), derived from *Euglena gracilis* ("EgD8S"; U.S. Pat. No. 7,256,033) (labeled as "D8S-23" in Figure);<br>Lip1: Lip1 terminator sequence from *Yarrowia* Lip1 gene (GenBank Accession No. Z50020) |
| PmeI/ClaI (10924-9068) | YAT1::EgD9eS::Lip2, comprising:<br>YAT1: *Yarrowia lipolytica* YAT1 promoter (labeled as "YAT" in Figure; U.S. Pat. Appl. Pub. No. 2006-0094102-A1);<br>EgD9eS: codon-optimized Δ9 elongase (SEQ ID NO: 45), derived from *Euglena gracilis* (U.S. Pat. No. 7,645,604);<br>Lip2: Lip2 terminator sequence from *Yarrowia* Lip2 gene (GenBank Accession No. AJ012632) |
| ClaI/EcoRI (9068-6999) | *Yarrowia* Ura3 gene (GenBank Accession No. AJ306421) |
| EcoRI/PacI (6999-4141) | GPDIN::EgD5SM::ACO, comprising:<br>GPDIN: *Yarrowia lipolytica* GPDIN promoter (U.S. Pat. No. 7,459,546);<br>EgD5SM: Synthetic mutant Δ5 desaturase (SEQ ID NO: 71; U.S. Pat. Pub. No. 2010-0075386-A1), derived from *Euglena gracilis* (U.S. Pat. No. 7,678,560) (labeled as "EgD5S-HPGS" in Figure);<br>Aco: Aco terminator sequence from *Yarrowia* Aco gene (GenBank Accession No. AJ001300) |

The pZKL2-5mB89C plasmid was digested with AscI/SphI, and then used for transformation of strain Y8069U3 according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that most of the selected 96 strains produced approximately 38-44% EPA of TFAs. Seven strains (i.e., #1, #39, #49, #62, #70, #85 and #92) that produced about 44.7%, 45.2%, 45.4%, 44.8%, 46.1%, 48.6% and 45.9% EPA of TFAs were designated as strains Y8151, Y8152, Y8153, Y8154, Y8155, Y8156 and Y8157, respectively. Knockout of the Lip2 gene was not confirmed in these EPA strains.

The final genotype of strains Y8151, Y8152, Y8153, Y8154, Y8155, Y8156 and Y8157 with respect to wildtype *Yarrowia lipolytica* ATCC #20362 was Ura+, Pex3−, unknown 1−, unknown 2−, unknown 3−, unknown 4−, unknown 5−, Leu+, Lys+, YAT1::ME3S::Pex16, FBAINm::EgD9eS::Lip2, EXP1::EgD9eS::Lip1, GPAT::EgD9e::Lip2, YAT1::EgD9eS::Lip2, FBAINm::EgD8M::Pex20, EXP1::EgD8M::Pex16, FBAIN::EgD8M::Lip1, GPD::FmD12::Pex20, YAT1::FmD12::Oct, EXP1::EgD5M::Pex16, YAT1::EaD5SM::Oct, FBAIN::EgD5SM::Pex20, GPDIN::EgD5SM::Aco, FBAINm::PaD17::Aco, EXP1::PaD17::Pex16, YAT1::PaD17S::Lip1, YAT1::YICPT::Aco.

Generation of Strain Y8154U1 (Ura3−)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8154, in a manner similar to that described for pZKUM transformation of strain Y8006 (supra). A total of 8 transformants were grown and identified to possess a Ura− phenotype.

GC analyses showed that there was 23.1% EPA of TFAs in the pZKUM-transformant strain #7. This strain was designated as strain Y8154U1.

Generation of Strain Y8269 to Produce About 45.3% EPA of TFAs

Figure 6A:
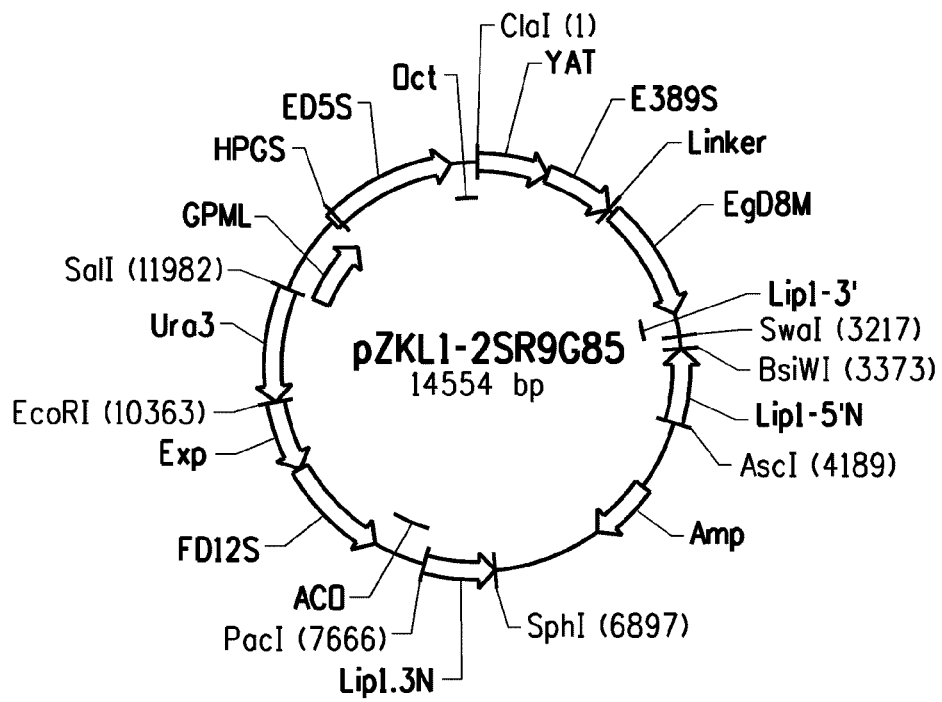

Construct pZKL1-2SR9G85 (FIG. 6A; SEQ ID NO:132) was generated to integrate one DGLA synthase, one Δ12 desaturase gene and one Δ5 desaturase gene into the Lip1 loci (GenBank Accession No. Z50020) of strain Y8154U1 to thereby enable higher level production of EPA. A DGLA synthase is a multizyme comprising a Δ9 elongase linked to a Δ8 desaturase.

The pZKL1-2SR9G85 plasmid contained the following components:

TABLE 8

Description of Plasmid pZKL1-2SR9G85 (SEQ ID NO: 132)

| RE Sites And Nucleotides Within SEQ ID NO: 132 | Description Of Fragment And Chimeric Gene Components |
|---|---|
| AscI/BsiWI (4189-3373) | 809 bp 5' portion of *Yarrowia* Lip1 gene (labeled as "Lip1-5'N" in Figure; GenBank Accession No. Z50020) |
| PacI/SphI (7666-6879) | 763 bp 3' portion of *Yarrowia* Lip1 gene (labeled as "Lip1.3N" in Figure; GenBank Accession No. Z50020) |
| ClaI/SwaI (1-3217) | YAT1::E389D9eS/EgD8M::Lip1, comprising:<br>YAT1: *Yarrowia lipolytica* YAT1 promoter (labeled as "YAT" in Figure; U.S. Pat. Appl. Pub. No. 2006-0094102-A1);<br>E389D9eS/EgD8M: gene fusion comprising a codon-optimized Δ9 elongase derived from *Eutreptiella* sp. CCMP389 ("E389D9eS"), a linker, and the synthetic mutant Δ8 desaturase derived from *Euglena gracilis* ("EgD8M") (SEQ ID NO: 12) (labeled as individually as "E389S", "Linker" and "EgD8M" in Figure; U.S. Pat. Appl. Pub. No. 2008-0254191-A1);<br>Lip1: Lip1 terminator sequence from *Yarrowia* Lip1 gene (GenBank Accession No. Z50020) |
| SalI/ClaI (11982-1) | GPM::EgD5SM::Oct comprising:<br>GPM: *Yarrowia lipolytica* GPM promoter (labeled as "GPML" in Figure; U.S. Pat. No. 7,202,356);<br>EgD5SM: Synthetic mutant Δ5 desaturase (SEQ ID NO: 71; U.S. Pat. Pub. No. 2010-0075386-A1), derived from *Euglena gracilis* (U.S. Pat. No. 7,678,560) (labeled as "ED5S" in Figure);<br>OCT: OCT terminator sequence of *Yarrowia* OCT gene (GenBank Accession No. X69988) |
| SalI/EcoRI (11982-10363) | *Yarrowia* Ura3 gene (GenBank Accession No. AJ306421) |
| EcoRI/PacI (10363-7666) | EXP1::FmD12S::ACO, comprising:<br>EXP1: *Yarrowia lipolytica* export protein (EXP1) promoter (labeled as "Exp" in Figure; Intl. App. Pub. No. WO 2006/052870);<br>FmD12S: codon-optimized Δ12 elongase (SEQ ID NO: 93), derived from *Fusarium moniliforme* (labeled as "FD12S" in Figure; U.S. Pat. No. 7,504,259);<br>Aco: Aco terminator sequence from *Yarrowia* Aco gene (GenBank Accession No. AJ001300) |

The pZKL1-2SR9G85 plasmid was digested with AscI/SphI, and then used for transformation of strain Y8154U1 according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that most of the selected 96 strains produced 40-44.5% EPA of total lipids. Five strains (i.e., #44, #46, #47, #66 and #87) that produced about 44.8%, 45.3%, 47%, 44.6% and 44.7% EPA of TFAs were designated as Y8268, Y8269, Y8270, Y8271 and Y8272, respectively. Knockout of the Lip1 loci (GenBank Accession No. Z50020) was not confirmed in these EPA strains.

The final genotype of strains Y8268, Y8269, Y8270, Y8271 and Y8272 with respect to wildtype *Yarrowia lipolytica* ATCC #20362 was Ura+, Pex3−, unknown 1-, unknown 2-, unknown 3-, unknown 4-, unknown 5-, unknown6-, YAT1::ME3S::Pex16, FBAINm::EgD9eS::Lip2, EXP1::EgD9eS::Lip1, GPAT::EgD9e::Lip2, YAT1::EgD9eS::Lip2, FBAINm::EgD8M::Pex20, EXP1::EgD8M::Pex16, FBAIN::EgD8M::Lip1, YAT1::E389D9eS/EgD8M::Lip1, GPD::FmD12::Pex20, YAT1::FmD12::Oct, EXP1::FmD12S::Aco, EXP1::EgD5M::Pex16, YAT1::EaD5SM::Oct, FBAIN::EgD5SM::Pex20, GPDIN::EgD5SM::Aco, GPM::EgD5SM::Oct, FBAINm::PaD17::Aco, EXP1::PaD17::Pex16, YAT1::PaD17S::Lip1, YAT1::YICPT::Aco.

Generation of Strain Y8269U (Ura3−)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8269, in a manner similar to that described for pZKUM transformation of strain Y8006 (supra). A total of 8 transformants were grown and identified to possess a Ura− phenotype.

GC analyses showed that there were 23.0%, 23.1% and 24.2% EPA of TFAs in pZKUM-transformant strains #2, #3 and #5, respectively. These strains were designated as strains Y8269U1, Y8269U2 and Y8269U3, respectively (collectively, Y8269U).

Figure 6B:
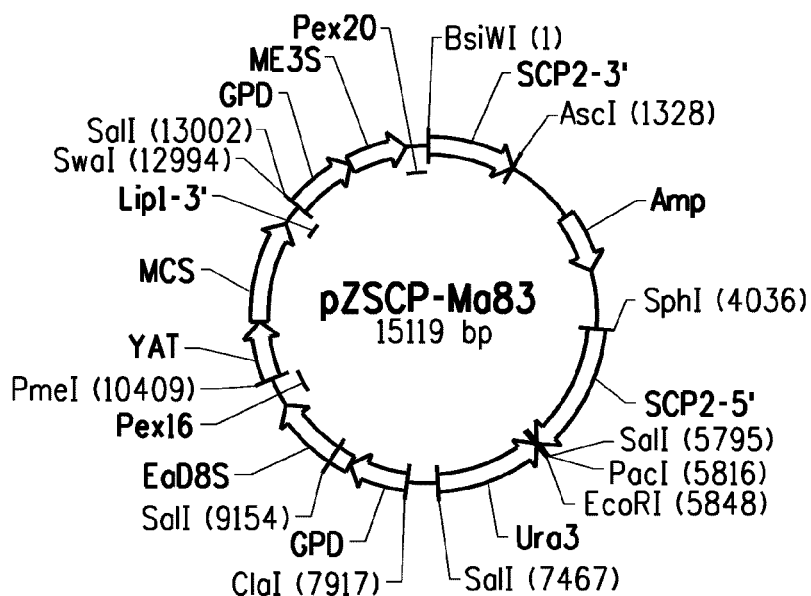

Generation of Strain Y8406 and Strain Y8412 To Produce About 51.2% EPA and 55.8% EPA of TFAs Construct pZSCP-Ma83 (FIG. 6B; SEQ ID NO:133) was generated to integrate one Δ8 desaturase gene, one $C_{16/18}$ elongase gene and one malonyl-CoA synthetase gene into the SCP2 loci (GenBank Accession No. XM 503410) of strain Y8269U1 to thereby enable higher level production of EPA. The pZSCP-Ma83 plasmid contained the following components:

TABLE 9

Description of Plasmid pZSCP-Ma83 (SEQ ID NO: 133)

| RE Sites And Nucleotides Within SEQ ID NO: 133 | Description Of Fragment And Chimeric Gene Components |
|---|---|
| BsiWI/AscI (1-1328) | 1327 bp 3' portion of *Yarrowia* SCP2 gene (labeled as "SCP2-3'" in Figure; GenBank Accession No. XM_503410) |
| SphI/PacI (4036-5816) | 1780 bp 5' portion of *Yarrowia* SCP2 gene (labeled as "SCP2-5'" in Figure; GenBank Accession No. XM_503410) |
| SwaI/BsiWI (12994-1) | GPD::ME3S::Pex20, comprising:<br>GPD: *Yarrowia lipolytica* GPD promoter (U.S. Pat. No. 7,259,255);<br>ME3S: codon-optimized $C_{16/18}$ elongase gene (SEQ ID NO: 97), derived from *M. alpina* (U.S. Pat. No. 7,470,532);<br>Pex20: Pex20 terminator sequence from *Yarrowia* Pex20 gene (GenBank Accession No. AF054613) |
| PmeI/SwaI (10409-12994) | YAT1::MCS::Lip1 comprising:<br>YAT1: *Yarrowia lipolytica* YAT1 promoter (labeled as "YAT" in Figure; U.S. Pat. Appl. Pub. No. 2006/0094102-A1);<br>MCS: codon-optimized malonyl-CoA synthetase gene (SEQ ID NO: 41), derived from *Rhizobium leguminosarum* bv. *viciae* 3841 (U.S. Patent Application No. 12/637877);<br>Lip1: Lip1 terminator sequence from *Yarrowia* Lip1 gene (GenBank Accession No. Z50020) |
| ClaI/PmeI (7917-10409) | GPD::EaD8S::Pex16 comprising:<br>GPD: *Yarrowia lipolytica* GPD promoter (U.S. Pat. No. 7,259,255);<br>EaD8S: codon-optimized Δ8 desaturase gene (SEQ ID NO: 63), derived from *Euglena anabaena* (U.S. Pat. Appl. Pub. No. 2008-0254521-A1);<br>Pex16: Pex16 terminator sequence from *Yarrowia* Pex16 gene (GenBank Accession No. U75433) |
| SalI/EcoRI (7467-5848) | *Yarrowia* Ura3 gene (GenBank Accession No. AJ306421) |

The pZSCP-Ma83 plasmid was digested with AscI/SphI, and then used for transformation of strains Y8269U1, Y8269U2 and Y8269U3, separately, according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

A total of 96 strains resulting from each pZSCP-Ma83 transformation (i.e., into Y8269U1, Y8269U2 and Y8269U3) were analyzed by GC. Most of the selected 288 strains produced 43-47% EPA of TFAs. Seven strains of Y8269U1 transformed with pZSCP-Ma83 (i.e., #59, #61, #65, #67, #70, #81 and #94) that produced about 51.3%, 47.9%, 50.8%, 48%, 47.8%, 47.8% and 47.8% EPA of TFAs were designated as strains Y8404, Y8405, Y8406, Y8407, Y8408, Y8409 and Y8410, respectively. Three strains of Y8269U2 transformed with pZSCP-Ma83 (i.e., #4, #13 and #17) that produced about 48.8%, 50.8%, and 49.3% EPA of TFAs were designated as Y8411, Y8412 and Y8413, respectively. And, two strains of Y8269U3 transformed with pZSCP-Ma83 (i.e., #2 and #16) that produced about 49.3% and 53.5% EPA of TFAs were designated as Y8414 and Y8415, respectively.

Knockout of the SCP2 loci (GenBank Accession No. XM_503410) in strains Y8404, Y8405, Y8406, Y8407, Y8408, Y8409, Y8410, Y8411, Y8412, Y8413, Y8414 and Y8415 was not confirmed in any of these EPA strains, produced by transformation with pZSCP-Ma83.

The final genotype of strains Y8404, Y8405, Y8406, Y8407, Y8408, Y8409, Y8410, Y8411, Y8412, Y8413, Y8414 and Y8415 with respect to wildtype *Yarrowia lipolytica* ATCC #20362 was Ura+, Pex3−, unknown 1−, unknown 2−, unknown 3−, unknown 4−, unknown 5−, unknown6−, unknown 7−, YAT1::ME3S::Pex16, GPD::ME3S::Pex20, FBAINm:: EgD9eS::Lip2, EXP1::EgD9eS::Lip1, GPAT::EgD9e::Lip2, YAT1::EgD9eS::Lip2, FBAINm::EgD8M::Pex20, EXP1:: EgD8M::Pex16, FBAIN::EgD8M::Lip1, GPD::EaD8S:: Pex16, YAT1::E389D9eS/EgD8M::Lip1, GPD::FmD12:: Pex20, YAT1::FmD12::Oct, EXP1::FmD12S::Aco, EXP1:: EgD5M::Pex16, YAT1::EaD5SM::Oct, FBAIN::EgD5SM:: Pex20, GPDIN::EgD5SM::Aco, GPM::EgD5SM::Oct, FBAINm::PaD17::Aco, EXP1::PaD17::Pex16, YAT1:: PaD17S::Lip1, YAT1::YICPT::Aco, YAT1::MCS::Lip1.

*Yarrowia lipolytica* strain Y8406 was deposited with the American Type Culture Collection on May 14, 2009 and bears the designation ATCC PTA-10025. *Yarrowia lipolytica* strain Y8412 was deposited with the American Type Culture Collection on May 14, 2009 and bears the designation ATCC PTA-10026.

Analysis of Total Lipid Content and Composition by Flask Assay

Cells from YPD plates of strains Y8404, Y8405, Y8406, Y8407, Y8408, Y8409, Y8410, Y8411, Y8412, Y8413, Y8414 and Y8415 were grown and analyzed for total lipid content and composition, according to the General Methods. Table 10 summarizes the total dry cell weight of the cells ["DCW"], the total lipid content of cells ["TFAs % DCW"], the concentration of each fatty acid as a weight percent of TFAs ["% TFAs"] and the EPA content as a percent of the dry cell weight ["EPA % DCW"]. More specifically, fatty acids are identified as 16:0 (palmitate), 16:1 (palmitoleic acid), 18:0 (stearic acid), 18:1 (oleic acid), 18:2 (LA), ALA, EDA, DGLA, ARA, ETrA, ETA, EPA and other.

TABLE 10

Total Lipid Content And Composition In *Yarrowia* Strains Y8404, Y8405, Y8406, Y8407, Y8408, Y8409, Y8410, Y8411, Y8412, Y8413, Y8414 And Y8415 By Flask Assay

| Strain | DCW (g/L) | TFAs % DCW | 16:0 | 16:1 | 18:0 | 18:1 | 18:2 | ALA | EDA | DGLA | ARA | EtrA | ETA | EPA | other | EPA % DCW |
|---|---|---|---|---|---|---|---|---|---|---|---|---|---|---|---|---|
| Y8404 | 4.1 | 27.3 | 2.8 | 0.8 | 1.8 | 5.1 | 20.4 | 2.1 | 2.9 | 2.5 | 0.6 | 0.8 | 2.4 | 51.1 | 6.3 | 14.0 |
| Y8405 | 3.9 | 29.6 | 2.7 | 0.5 | 2.9 | 5.7 | 20.5 | 2.8 | 2.7 | 2.1 | 0.5 | 0.7 | 2.0 | 51.4 | 5.1 | 15.2 |
| Y8406 | 4.0 | 30.7 | 2.6 | 0.5 | 2.9 | 5.7 | 20.3 | 2.8 | 2.8 | 2.1 | 0.5 | 0.8 | 2.1 | 51.2 | 5.4 | 15.7 |
| Y8407 | 4.0 | 29.4 | 2.6 | 0.5 | 3.0 | 5.6 | 20.5 | 2.8 | 2.7 | 2.1 | 0.4 | 0.7 | 2.1 | 51.5 | 5.1 | 15.2 |
| Y8408 | 4.1 | 29.8 | 2.9 | 0.6 | 2.7 | 5.7 | 20.2 | 2.8 | 2.6 | 2.1 | 0.5 | 0.9 | 2.1 | 51.2 | 5.5 | 15.3 |
| Y8409 | 3.9 | 30.8 | 2.8 | 0.5 | 2.9 | 5.7 | 20.6 | 2.7 | 2.7 | 2.1 | 0.5 | 0.8 | 2.1 | 51.0 | 5.2 | 15.7 |
| Y8410 | 4.0 | 31.8 | 2.7 | 0.5 | 3.0 | 5.7 | 20.5 | 2.9 | 2.7 | 2.1 | 0.5 | 0.7 | 2.1 | 50.9 | 5.3 | 16.2 |
| Y8411 | 3.6 | 30.5 | 2.7 | 0.3 | 3.3 | 5.1 | 19.9 | 2.6 | 2.4 | 2.0 | 0.5 | 0.6 | 1.8 | 52.9 | 5.7 | 16.1 |
| Y8412 | 3.2 | 27.0 | 2.5 | 0.4 | 2.6 | 4.3 | 19.0 | 2.4 | 2.2 | 2.0 | 0.5 | 0.6 | 1.9 | 55.8 | 5.6 | 15.1 |
| Y8413 | 2.9 | 27.2 | 3.1 | 0.4 | 2.6 | 5.4 | 19.9 | 2.2 | 2.8 | 2.0 | 0.5 | 0.7 | 1.8 | 52.4 | 5.9 | 14.2 |
| Y8414 | 3.7 | 27.1 | 2.5 | 0.7 | 2.3 | 6.0 | 19.9 | 1.6 | 3.4 | 3.4 | 0.6 | 0.6 | 3.1 | 49.4 | 6.1 | 13.4 |
| Y8415 | 3.6 | 25.9 | 1.4 | 0.3 | 1.9 | 4.5 | 16.0 | 1.3 | 2.7 | 2.9 | 0.5 | 0.6 | 2.5 | 59.0 | 6.1 | 15.3 |

Example 4

Generation of *Yarrowia lipolytica* Strain Y8647 to Produce About 53.6% EPA of Total Fatty Acids ["TFAs"] with 37.6% Total Lipid Content The present Example describes the construction of strain Y8647, derived from *Yarrowia lipolytica* ATCC #20362, capable of producing about 53.6% EPA relative to the total lipids with 37.6% total lipid content ["TFAs % DCW"] via expression of a Δ9 elongase/Δ8 desaturase pathway. The development of strain Y8647 (FIG. 2) required the construction of strains Y2224, Y4001, Y4001U, Y4036, Y4036U and L135 (described in Example 1), strains L135U9 and Y8002 (described in Example 2), strains Y8006U6, Y8069, Y8069U, Y8154, Y8154U, Y8269 and Y8269U (described in Example 3) and strain Y8412U6.

Generation of Strain Y8412U6 (Ura3−)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8412 (Example 3) in a manner similar to that described for pZKUM transformation of strain Y8006 (Example 3). A total of 8 transformants were grown and identified to possess a Ura− phenotype.

GC analyses showed that there were 25.9% and 26.9% EPA of TFAs in pZKUM-transformant strains #4 and #6, respectively. These two strains were designated as strains Y8412U6 and Y8412U8, respectively (collectively, Y8412U).

Generation of Strain Y8647

Figure 7A:
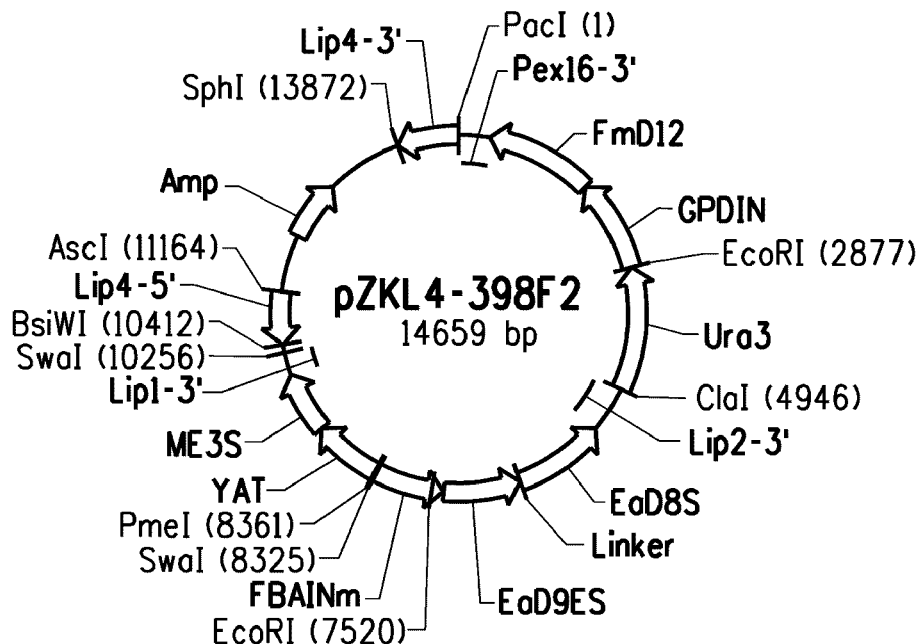

Construct pZKL4-398F2 (FIG. 7A; SEQ ID NO:134) was generated to integrate one $C_{16/18}$ elongase gene, one DGLA synthase, and one Δ12 desaturase gene into the *Yarrowia* lipase-like locus (designated as Lip4, GenBank Accession No. XM 503825) of strain Y8412U6 to thereby enable higher level production of EPA. The pZKL4-398F2 plasmid contained the following components:

TABLE 11

| Description of Plasmid pZKL4-398F2 (SEQ ID NO: 134) | |
|---|---|
| RE Sites And Nucleotides Within SEQ ID NO: 134 | Description Of Fragment And Chimeric Gene Components |
| AscI/BsiWI (11164-10412) | 745 by 5' portion of *Yarrowia* Lipase 4 locus (labeled as "Lip4" in Figure; GenBank Accession No. XM_503825) |
| PacI/SphI (1-13872) | 782 by 3' portion of *Yarrowia* Lipase 4 locus (labeled as "Lip4-3'" in Figure; GenBank Accession No. XM_503825) |
| EcoRI/PacI (2877-1) | GPDIN::FmD12::Pex16, comprising: GPDIN: *Yarrowia lipolytica* GPDIN promoter (U.S. Pat. No. 7,459,546); FmD12: *Fusarium moniliforme* Δ12 desaturase (SEQ ID NO: 91) (labeled as "F.D12" in Figure; U.S. Pat. No. 7,504,259); Pex16: Pex16 terminator sequence from *Yarrowia* Pex16 gene (Gen Bank Accession No. U75433) |
| PmeI/SwaI (8361-10256) | YAT1::ME3S::Lip1 comprising: YAT1: *Yarrowia lipolytica* YAT1 promoter (labeled as "YAT" in Figure; U.S. Pat. Appl. Pub. No. 2006-0094102-A1); ME3S: codon-optimized $C_{16/18}$ elongase gene (SEQ ID NO: 97), derived from *M. alpina* (U.S. Pat. No. 7,470,532); Lip1: Lip1 terminator sequence from *Yarrowia* Lip1 gene (GenBank Accession No. Z50020) |
| SwaI/ClaI (8325-4946) | FBAINm::EaD9eS/EaD8S::Lip2 comprising: FBAINm: *Yarrowia lipolytica* FBAINm promoter (U.S. Pat. No. 7,202,356); EaD9eS/EaD8S: gene fusion comprising a codon-optimized Δ9 elongase derived from *Euglena anabaena* ("EaD9eS"), a |

TABLE 11-continued

Description of Plasmid pZKL4-398F2 (SEQ ID NO: 134)

| RE Sites And Nucleotides Within SEQ ID NO: 134 | Description Of Fragment And Chimeric Gene Components |
|---|---|
| | linker, and a codon-optimized Δ8 desaturase derived from *Euglena anabaena* ("EaD8S") (SEQ ID NO: 63) (labeled as individually as "EaD9E9S", "Linker" and "EaD8S" in Figure; U.S. Pat. Appl. Pub. No. 2008-0254191-A1); Lip2: Lip2 terminator sequence from *Yarrowia* Lip2 gene (GenBank Accession No. AJ012632) |
| ClaI/EcoRI (49146-2877) | *Yarrowia* Ura3 gene (GenBank Accession No. AJ306421) |

The pZKL4-398F2 plasmid was digested with AscI/SphI, and then used for transformation of strain Y8412U6, according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

composition, according to the General Methods. Table 12 summarizes the total dry cell weight of the cells ["DCW"], the total lipid content of cells ["TFAs % DCW"], the concentration of each fatty acid as a weight percent of TFAs ["% TFAs"] and the EPA content as a percent of the dry cell weight ["EPA % DCW"]. Fatty acids are identified as 16:0 (palmitate), 16:1 (palmitoleic acid), 18:0 (stearic acid), 18:1 (oleic acid), 18:2 (LA), ALA, EDA, DGLA, ARA, ETrA, ETA, EPA and other.

TABLE 12

Total Lipid Content And Composition In *Yarrowia* Strains Y8647, Y8648, Y8649 And Y8650 By Flask Assay

| Strain | DCW (g/L) | TFAs % DCW | % TFAs | | | | | | | | | | | | EPA % DCW |
|---|---|---|---|---|---|---|---|---|---|---|---|---|---|---|---|
| | | | 16:0 | 16:1 | 18:0 | 18:1 | 18:2 | ALA | EDA | DGLA | ARA | EtrA | ETA | EPA | other | |
| Y8647 | 3.8 | 37.6 | 1.3 | 0.2 | 2.1 | 4.7 | 20.3 | 1.7 | 3.3 | 3.6 | 0.7 | 0.6 | 3.0 | 53.6 | 4.5 | 20.1 |
| Y8648 | 3.5 | 27.8 | 2.3 | 0.3 | 2.7 | 4.3 | 18.6 | 2.3 | 2.1 | 2.2 | 0.6 | 0.6 | 1.9 | 56.7 | 4.9 | 15.7 |
| Y8649 | 3.6 | 27.9 | 2.4 | 0.3 | 2.9 | 3.7 | 18.8 | 2.2 | 2.1 | 2.4 | 0.6 | 0.8 | 2.1 | 55.8 | 5.5 | 15.6 |
| Y8650 | 3.5 | 28.2 | 2.2 | 0.3 | 2.9 | 3.8 | 18.8 | 2.4 | 2.1 | 2.4 | 0.6 | 0.6 | 2.1 | 56.1 | 5.3 | 15.8 |

GC analyses showed that most of the selected 96 transformant strains produced 50-52.7% EPA of TFAs. Seven strains (i.e., #31, #35, #38, #41, #60, #61 and #95) that produced about 52.8%, 53.1%, 52.8%, 53.2%, 53.1%, 52.8%, and 52.9% EPA of TFAs were designated as Y8646, Y8647, Y8648, Y8649, Y8650, Y8651 and Y8652, respectively.

Knockout of the Lip4 locus (GenBank Accession No. XM_503825) in these EPA strains was not confirmed.

The final genotype of strains Y8646, Y8647, Y8648, Y8649, Y8650, Y8651 and Y8652 with respect to wildtype *Yarrowia lipolytica* ATCC #20362 was Ura+, Pex3-, unknown 1-, unknown 2-, unknown 3-, unknown 4-, unknown 5-, unknown6-, unknown 7-, unknown 8-, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, FBAINm::EgD8M::Pex20, EXP1::EgD8M::Pex16, FBAIN::EgD8M::Lip1, GPD::EaD8S::Pex16, YAT1::E389D9eS/EgD8M::Lip1, FBAINm::EaD9eS/EaD8S::Lip2, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, GPDIN::EgD5SM::Aco, GPM::EgD5SM::Oct, YAT1::EaD5SM::Oct, FBAINm::PaD17::Aco, EXP1::PaD17::Pex16, YAT1::PaD17S::Lip1, YAT1::YICPT::Aco, YAT1::MCS::Lip1.

Analysis of Total Lipid Content and Composition by Flask Assay

Cells from YPD plates of strains Y8647, Y8648, Y8649 and Y8650 were grown and analyzed for total lipid content and Example 5

Generation of *Yarrowia lipolytica* Strain Y9028 to Produce About 54.5% EPA of Total Fatty Acids ["TFAs"] with 39.6% Total Lipid Content The present Example describes the construction of strain Y9028, derived from *Yarrowia lipolytica* ATCC #20362, capable of producing about 54.5% EPA relative to the total lipids with 39.6% total lipid content ["TFAs % DCW"] via expression of a Δ9 elongase/Δ8 desaturase pathway. The development of strain Y9028 (FIG. 2) required the construction of strains Y2224, Y4001, Y4001U, Y4036, Y4036U and L135 (described in Example 1), strains L135U9 and Y8002 (described in Example 2), strains Y8006U6, Y8069, Y8069U, Y8154, Y8154U, Y8269 and Y8269U (described in Example 3), strains Y8412U6 and Y8647 (described in Example 4) and strain Y8467U.

Generation of Strain Y8647U (Ura3-)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8647 (Example 4) in a manner similar to that described for pZKUM transformation of strain Y8006 (Example 3). A total of 12 transformants were grown and identified to possess a Ura- phenotype.

GC analyses showed that there were 30.2%, 29.2%, 28.1% and 29.9% EPA of TFAs in pZKUM-transformant strains #1, #3, #4 and #12, respectively. These four strains were designated as strains Y8647U1, Y8647U2, Y8647U3, and Y8647U6, respectively (collectively, Y8647U).

Generation Of Strain Y9028

Figure 7B:
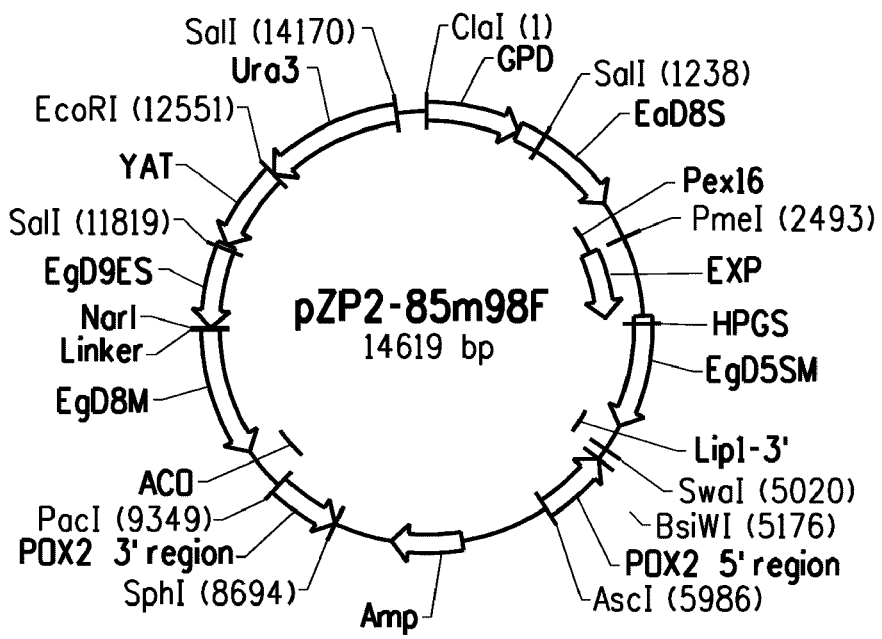

Construct pZP2-85 m98F (FIG. 7B; SEQ ID NO:135) was generated to integrate one Δ8 desaturase gene, one DGLA synthase and one Δ5 desaturase gene into the *Yarrowia* Pox2 locus (GenBank Accession No. AJ001300) of strain Y8647U3 to thereby enable higher level production of EPA. The pZP2-85 m98F plasmid contained the following components:

TABLE 13

Description of Plasmid pZP2-85m98F (SEQ ID NO: 135)

| RE Sites And Nucleotides Within SEQ ID NO: 135 | Description Of Fragment And Chimeric Gene Components |
|---|---|
| AscI/BsiWI (5986-5176) | 810 by 5' portion of *Yarrowia* Pox2 gene (GenBank Accession No. AJ001300) |
| PacI/SphI (9349-8694) | 655 by 3' portion of *Yarrowia* Pox2 gene (GenBank Accession No. AJ001300) |
| PmeI/SwaI (2493-5020) | EXP1::EgD5SM::Lip1, comprising:<br>EXP1: *Yarrowia lipolytica* export protein (EXP1) promoter (labeled as "EXP" in Figure; Intl. App. Pub. No. WO 2006/052870);<br>EgD5SM: Synthetic mutant Δ5 desaturase (SEQ ID NO: 71; U.S. Pat. Pub. No. 2010-0075386-A1), derived from *Euglena gracilis* (U.S. Pat. No. 7,678,560);<br>Lip1: Lip1 terminator sequence from *Yarrowia* Lip1 gene (GenBank Accession No. Z50020) |
| ClaI/PmeI (1-2493) | GPD::EaD8S::Pex16, comprising:<br>GPD: *Yarrowia lipolytica* GPD promoter (U.S. Pat. No. 7,259,255);<br>EaD8S: codon-optimized Δ8 desaturase gene (SEQ ID NO: 63), derived from *Euglena anabaena* (U.S. Pat. Appl. Pub. No. 2008-0254521-A1);<br>Pex16: Pex16 terminator sequence from *Yarrowia* Pex16 gene (GenBank Accession No. U75433) |
| SalI/EcoRI (14170-12551) | *Yarrowia* Ura3 gene (GenBank Accession No. AJ306421) |
| EcoRI/PacI (12551-9349) | YAT1::EgD9eS/EgD8M::Aco, comprising:<br>YAT1: *Yarrowia lipolytica* YAT1 promoter (labeled as "YAT" in Figure; U.S. Pat. Appl. Pub. No. 2006/0094102-A1);<br>EgD9eS/EgD8M: gene fusion comprising a codon-optimized Δ9 elongase derived from *Euglena gracilis* ("EgD9eS"), a linker, and the synthetic mutant Δ8 desaturase derived from *Euglena gracilis* ("EgD8M") (SEQ ID NO: 8) (labeled as individually as "EgD9eS", "Linker" and "EgD8M" in Figure; U.S. Pat. Appl. Pub. No. 2008-0254191-A1);<br>Aco: Aco terminator sequence from *Yarrowia* Aco gene (GenBank Accession No. AJ001300) |

The pZP2-85 m98F plasmid was digested with AscI/SphI, and then used for transformation of strains of Y8647U1, Y8647U2, Y8647U3 and Y8647U6, individually, according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that most of the selected 48 strains of Y8647U1 transformed with pZP2-85 m98F produced 49-52% EPA of TFAs. Two strains (i.e., #30 and #31) that produced about 52.6% and 52.1% EPA of TFAs were designated as Y9024 and Y9025, respectively.

Most of the selected 60 strains of Y8647U2 transformed with pZP2-85 m98F produced 49-51.9% EPA of TFAs. Strain #6 produced about 52% EPA of TFAs and was designated as Y9026.

Most of the selected 60 strains of Y8647U3 transformed with pZP2-85 m98F produced 50-52.2% EPA of TFAs. Six strains (i.e., #5, #6, #14, #15, #20 and #34) that produced about 53.2%, 53.7%, 54.0%, 52.9%, 53.4% and 52.3% EPA of TFAs were designated as Y9027, Y9028, Y9029, Y9030, Y9031 and Y9032, respectively.

Similarly, GC analyses showed that most of the selected 48 strains of Y8647U6 transformed with pZP2-85 m98F produced 50-52.1% EPA of TFAs. Two strains (i.e., #27 and #44) that produced about 52.2% and 52.8% EPA of TFAs were designated as Y9033 and Y9034, respectively.

Knockout of the Pox2 locus (GenBank Accession No. AJ001300) in strains Y9024, Y9025, Y9026, Y9027, Y9028, Y9029, Y9030, Y9031, Y9032, Y9033 and Y9034 was not confirmed in any of these EPA strains, produced by transformation with pZP2-85 m98F.

The final genotype of these strains with respect to wildtype *Yarrowia lipolytica* ATCC #20362 was Ura+, Pex3−, unknown 1-, unknown 2-, unknown 3-, unknown 4-, unknown 5-, unknown6−, unknown 7-, unknown 8-, unknown9−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::

Aco, FBAINm::EaD9eS/EaD8S::Lip2, GPD::FmD12::Pex20, YAT1::FmD12::Oct, EXP1::FmD12S::Aco, GPDIN::FmD12::Pex16, EXP1::EgD5M::Pex16, FBAIN::EgD5M::Pex20, GPDIN::EgD5SM::Aco, GPM::EgD5SM::Oct, EXP1::EgD5SM::Lip1, YAT1::EaD5SM::Oct, FBAINm::PaD17::Aco, EXP1::PaD17::Pex16, YAT1::PaD17S::Lip1, YAT1::YICPT::Aco, YAT1::MCS::Lip1.

Analysis of Total Lipid Content and Composition by Flask Assay

Cells from YPD plates of strains Y9028, Y9029 and Y9031 were grown and analyzed for total lipid content and composition, according to the General Methods.

Table 14 below summarizes the total dry cell weight of the cells ["DCW"], the total lipid content of cells ["TFAs % DCW"], the concentration of each fatty acid as a weight percent of TFAs ["% TFAs"] and the EPA content as a percent of the dry cell weight ["EPA % DCW"]. More specifically, fatty acids are identified as 16:0 (palmitate), 16:1 (palmitoleic acid), 18:0 (stearic acid), 18:1 (oleic acid), 18:2 (LA), ALA, EDA, DGLA, ARA, EtrA, ETA, EPA and other.

DCW"], while strain Y9502 is capable of producing about 57% EPA relative to the total lipids with 37.1% TFAs % DCW.

The development of strains Y9481 and Y9502 (FIG. 2) required the construction of strains Y2224, Y4001, Y4001U, Y4036, Y4036U and L135 (described in Example 1), strains L135U9 and Y8002 (described in Example 2), strains Y8006U6, Y8069, Y8069U, Y8154, Y8154U, Y8269 and Y8269U (described in Example 3), strains Y8412U6 and Y8647 (described in Example 4), strains Y8467U and Y9028 (described in Example 5) and strain Y9028U.

Generation of Strain Y9028U (Ura3−)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y9028 (Example 5) in a manner similar to that described for pZKUM transformation of strain Y8006 (Example 3). A total of 8 transformants were grown and identified to possess a Ura− phenotype.

TABLE 14

Total Lipid Content And Composition In *Yarrowia* Strains Y9028, Y9029 and Y9031 By Flask Assay

| Strain | DCW (g/L) | TFAs % DCW | % TFAs |||||||||||| EPA % DCW |
|---|---|---|---|---|---|---|---|---|---|---|---|---|---|---|---|
| | | | 16:0 | 16:1 | 18:0 | 18:1 | 18:2 | ALA | EDA | DGLA | ARA | EtrA | ETA | EPA | other | |
| Y9028 | 3.3 | 39.6 | 1.3 | 0.2 | 2.1 | 4.4 | 19.8 | 1.7 | 3.2 | 2.5 | 0.8 | 0.7 | 1.9 | 54.5 | 6.1 | 21.6 |
| Y9029 | 3.2 | 38.4 | 1.3 | 0.3 | 1.7 | 4.4 | 19.8 | 1.5 | 3.2 | 3.3 | 0.9 | 0.7 | 2.4 | 53.8 | 6.0 | 20.7 |
| Y9031 | 3.3 | 38.6 | 1.3 | 0.3 | 1.8 | 4.7 | 20.1 | 1.7 | 3.2 | 3.2 | 0.9 | 0.8 | 2.6 | 52.3 | 6.3 | 20.2 |

Example 6

Generation of *Yarrowia lipolytica* Strains Y9481 And Y9502, Producing at Least About 57% EPA of Total Fatty Acids ["TFAs"] with at Least About 35% Total Lipid Content The present Example describes the construction of strains Y9481 and Y9502, derived from *Yarrowia lipolytica* ATCC #20362 and expressing a Δ9 elongase/Δ8 desaturase pathway. Strain Y9481 is capable of producing about 60.9% EPA relative to the total lipids with 35% total lipid content ["TFAs %

GC analyses showed that there were 24.1%, 24.9%, 24.5% and 24.5% EPA of TFAs in pZKUM-transformant strains #1, #3, #4, and #5, respectively. These four strains were designated as strains Y9028U1, Y9028U2, Y9028U3, and Y9028U4, respectively (collectively, Y9028U).

Components of Integration Vector pZK16-ML8N

Figure 8A:
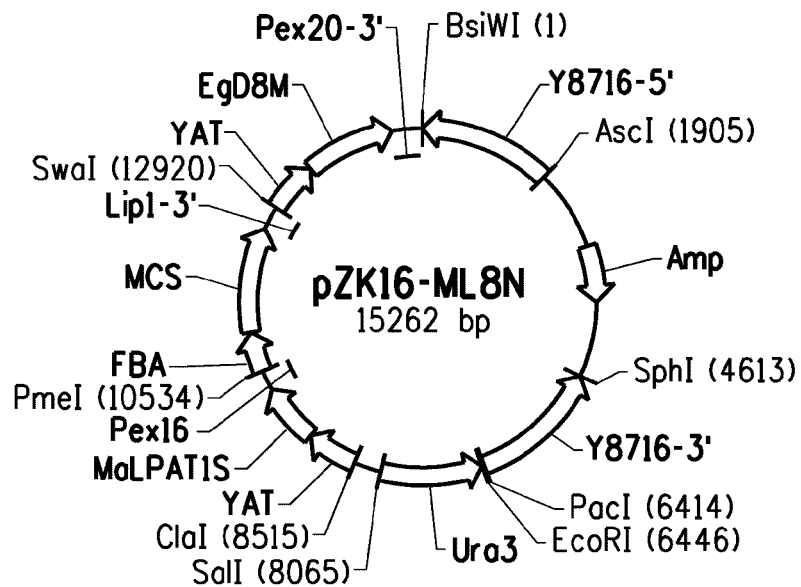

Construct pZK16-ML8N (FIG. 8A; SEQ ID NO:136) was generated to integrate one Δ8 desaturase gene, one malonyl-CoA synthetase gene, and one lysophosphatidic acid acyltransferase gene ["LPAAT"] into the *Yarrowia* YALI0B14795p locus (GenBank Accession No. XM_500900) of strain Y9028U2. The pZK16-ML8N plasmid contained the following components:

TABLE 15

| Description of Plasmid pZK16-ML8N (SEQ ID NO: 136) ||
|---|---|
| RE Sites And Nucleotides Within SEQ ID NO: 136 | Description Of Fragment And Chimeric Gene Components |
| AscI/BsiWI (1905-1) | 1904 by 5' portion of YALI0B14795p locus (GenBank Accession No. XM_500900, labeled as "Y8716-5'" in Figure) |
| PacI/SphI (6414-4613) | 1801 by 3' portion of YALI0B14795p locus (GenBank Accession No. XM_500900, labeled as "Y8716-3'" in Figure) |
| SwaI/BsiWI (12920-1) | YAT1::EgD8M::Pex20, comprising:<br>YAT1: *Yarrowia lipolytica* YAT1 promoter (labeled as "YAT" in Figure; U.S. Pat. Appl. Pub. No. 2006-0094102-A1);<br>EgD8M: Synthetic mutant Δ8 desaturase (SEQ ID NO: 59; U.S. Pat. No. 7,709,239), derived from *Euglena gracilis* ("EgD8S"; U.S. Pat. No. 7,256,033);<br>Pex20: Pex20 terminator sequence from *Yarrowia* Pex20 gene (GenBank Accession No. AF054613) |
| PmeI/SwaI (10534-12920) | FBA::MCS::Lip1, comprising:<br>FBA: *Yarrowia lipolytica* FBA promoter (U.S. Pat. No. 7,202,356);<br>MCS: codon-optimized malonyl-CoA synthetase gene (SEQ |

TABLE 15-continued

Description of Plasmid pZK16-ML8N (SEQ ID NO: 136)

| RE Sites And Nucleotides Within SEQ ID NO: 136 | Description Of Fragment And Chimeric Gene Components |
|---|---|
| | ID NO: 41), derived from *Rhizobium leguminosarum* bv. *viciae* 3841 (U.S. Patent Application No. 12/637877); Lip1: Lip1 terminator sequence from *Yarrowia* Lip1 gene (GenBank Accession No. Z50020) |
| ClaI/PmeI (8515-10534) | YAT1::MaLPAAT1S::Pex16, comprising: YAT1: *Yarrowia lipolytica* YAT1 promoter (labeled as "YAT" in Figure; U.S. Pat. Appl. Pub. No. 2006-0094102-A1); MaLPAAT1S: codon-optimized lysophosphatidic acid acyltransferase gene (SEQ ID NO: 35), derived from *Mortierella alpine* (U.S. Pat. Appl. Pub. No. 2006-0115881-A1; U.S. Pat. Appl. Pub. No. 2009-0325265-A1); Pex16: Pex16 terminator sequence from *Yarrowia* Pex16 gene (GenBank Accession No. U75433) |
| SalI/EcoRI (8065-6446) | *Yarrowia* Ura3 gene (GenBank Accession No. AJ306421) |

Components of Integration Vector pZK16-ML

Figure 8B:
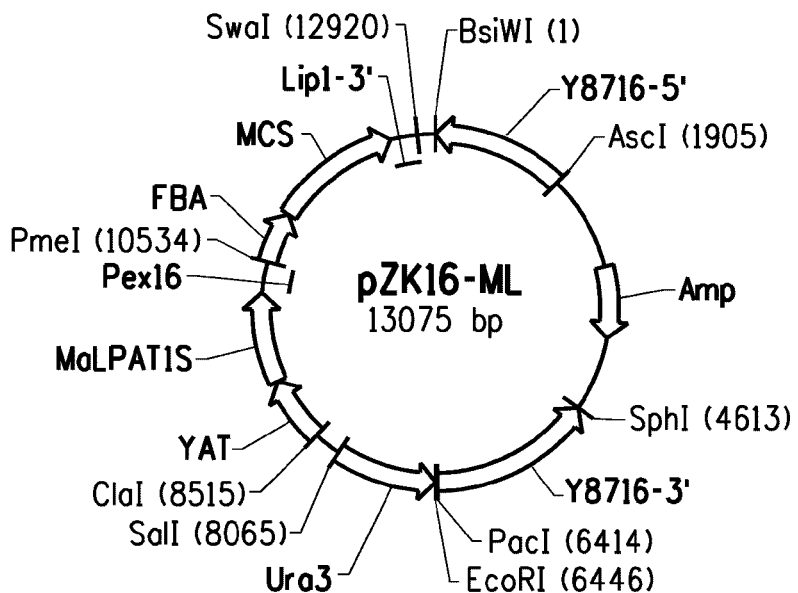

Construct pZK16-ML (FIG. 8B; SEQ ID NO:137) was generated to integrate one malonyl-CoA synthetase gene and one lysophosphatidic acid acyltransferase gene ["LPAAT"] into the *Yarrowia* YALI0B14795p locus (GenBank Accession No. XM_500900) of strain Y9028U2. The components of the pZK16-ML plasmid are identical to those of pZK16-ML8N (supra); however, the chimeric YAT1::EgD8M::Pex20 gene of pZK16-ML8N is lacking.

Generation of Strains Y9481 and Y9502

The pZK16-ML8N plasmid and pZK16-ML plasmid were each individually digested with AscI/SphI, and then used separately for transformation of strain Y9028U2, according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that most of the selected 96 strains of Y9028U2 with pZK16-ML8N produced 50-55.4% EPA of TFAs. Fifteen strains (i.e., #8, #18, #21, #24, #29, #48, #60, #66, #68, #75, #76, #78, #90, #95 and #96) that produced about 58.1%, 61.4%, 56.2%, 58.1%, 57.5%, 57.0%, 55.9%, 57.6%, 57.8%, 55.5%, 57.6%, 58.1%, 57.1%, 56.2% and 58.6% EPA of TFAs were designated as Y9472, Y9473, Y9474, Y9475, Y9476, Y9477, Y9478, Y9479, Y9480, Y9481, Y9482, Y9483, Y9484, Y9485 and Y9486, respectively.

The final genotype of these pZK16-ML8N transformant strains with respect to wildtype *Yarrowia lipolytica* ATCC #20362 was Ura+, Pex3−, unknown 1−, unknown 2−, unknown 3−, unknown 4−, unknown 5−, unknown6−, unknown 7−, unknown 8−, unknown9−, unknown 10−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, FBAINm::EgD8M::Pex20, EXP1::EgD8M::Pex16, FBAIN::EgD8M::Lip1, YAT1::EgD8M::Pex20, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, GPDIN::EgD5SM::Aco, GPM::EgD5SM::Oct, EXP1::EgD5SM::Lip1, YAT1::EaD5SM::Oct, FBAINm::PaD17::Aco, EXP1::PaD17::Pex16, YAT1::PaD17S::Lip1, YAT1::YICPT::Aco, YAT1::MCS::Lip1, FBA::MCS::Lip1, YAT1::MaLPAAT1S::Pex16.

Similarly, GC analyses showed that most of the selected 96 strains of Y9028U2 with pZK16-ML produced 51-55.5% EPA of TFAs. Sixteen strains (i.e., #4, #8, #15, #16, #39, #44, #46, #63, #66, #80, #85, #86, #88, #89, #90 and #96) that produced about 56.5%, 57.4%, 56.8%, 57.0%, 56.4%, 57.3%, 58.2%, 55.6%, 57.8%, 55.6%, 57.6%, 56.8%, 55.8%, 56.4%, 56.1% and 57% EPA of TFAs were designated as Y9496, Y9497, Y9498, Y9499, Y9500, Y9501, Y9502, Y9503, Y9504, Y9505, Y9506, Y9507, Y9508, Y9509, Y9510 and Y9511, respectively.

The final genotype of these pZK16-ML transformant strains with respect to wildtype *Yarrowia lipolytica* ATCC #20362 was Ura+, Pex3−, unknown 1−, unknown 2−, unknown 3−, unknown 4−, unknown 5−, unknown6−, unknown 7−, unknown 8−, unknown9−, unknown 10−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, GPDIN::EgD5SM::Aco, GPM::EgD5SM::Oct, EXP1::EgD5SM::Lip1, YAT1::EaD5SM::Oct, FBAINm::PaD17::Aco, EXP1::PaD17::Pex16, YAT1::PaD17S::Lip1, YAT1::YICPT::Aco, YAT1::MCS::Lip1, FBA::MCS::Lip1, YAT1::MaLPAAT1S::Pex16.

Knockout of the YALI0B14795p locus (GenBank Accession No. XM_500900) in strains Y9472, Y9473, Y9474, Y9475, Y9476, Y9477, Y9478, Y9479, Y9480, Y9481, Y94782, Y9483, Y9484, Y9485, Y9486, Y9496, Y9497, Y9498, Y9499, Y9500, Y9501, Y9502, Y9503, Y9504, Y9505, Y9506, Y9507, Y9508, Y9509, Y9510 and Y9511 was not confirmed in any of these EPA strains, produced by transformation with pZK16-ML8N or pZK16-ML.

Analysis of Total Lipid Content and Composition by Flask Assay

Cells from YPD plates of strains Y9477, Y9481, Y9486, Y9497, Y9502, Y9504, Y9508 and Y9510 were grown and analyzed for total lipid content and composition, according to the General Methods.

Table 16 below summarizes the total dry cell weight of the cells ["DCW"], the total lipid content of cells ["TFAs % DCW"], the concentration of each fatty acid as a weight percent of TFAs ["% TFAs"] and the EPA content as a percent of the dry cell weight ["EPA % DCW"]. More specifically, fatty acids are identified as 16:0 (palmitate), 16:1 (palmitoleic acid), 18:0 (stearic acid), 18:1 (oleic acid), 18:2 (LA), ALA, EDA, DGLA, ARA, ETrA, ETA, EPA and other.

expression of a Δ9 elongase/Δ8 desaturase pathway. The development of strain Y8672 (FIG. 9) required the construction of strains Y2224, Y4001, Y4001U, Y4036, Y4036U and L135 (described in Example 1), strains L135U9 and Y8002 (described in Example 2), strains Y8006U6, Y8069, Y8069U (described in Example 3) and strains Y8145, Y8145U, Y8259, Y8259U, Y8367 and Y8367U.

TABLE 16

Total Lipid Content And Composition In *Yarrowia* Strains Y9477, Y9481, Y9486, Y9497, Y9502, Y9504, Y9508 and Y9510 By Flask Assay

| Strain | DCW (g/L) | TFAs % DCW | % TFAs | | | | | | | | | | | | EPA % DCW |
|---|---|---|---|---|---|---|---|---|---|---|---|---|---|---|---|
| | | | 16:0 | 16:1 | 18:0 | 18:1 | 18:2 | ALA | EDA | DGLA | ARA | EtrA | ETA | EPA | other | |
| Y9477 | 3.2 | 32.6 | 2.6 | 0.5 | 3.4 | 4.8 | 10.0 | 0.5 | 2.5 | 3.7 | 1.0 | 0.5 | 2.1 | 61.4 | 6.9 | 20.0 |
| Y9481 | 3.1 | 35.0 | 2.5 | 0.5 | 3.1 | 4.7 | 11.0 | 0.6 | 2.6 | 3.6 | 0.9 | 0.5 | 2.1 | 60.9 | 6.8 | 21.3 |
| Y9486 | 3.1 | 32.2 | 2.1 | 0.7 | 1.8 | 4.2 | 11.9 | 0.6 | 2.9 | 4.2 | 1.2 | 0.7 | 2.4 | 60.3 | 6.7 | 19.4 |
| Y9497 | 3.7 | 33.7 | 2.4 | 0.5 | 3.2 | 4.6 | 11.3 | 0.8 | 3.1 | 3.6 | 0.9 | 0.7 | 2.3 | 58.7 | 7.1 | 19.8 |
| Y9502 | 3.8 | 37.1 | 2.5 | 0.5 | 2.9 | 5.0 | 12.7 | 0.9 | 3.5 | 3.3 | 0.8 | 0.7 | 2.4 | 57.0 | 7.5 | 21.3 |
| Y9504 | 3.7 | 33.7 | 2.2 | 0.5 | 3.0 | 4.5 | 11.3 | 0.7 | 2.9 | 3.5 | 0.9 | 0.7 | 2.3 | 59.9 | 7.1 | 20.1 |
| Y9508 | 3.7 | 34.9 | 2.3 | 0.5 | 2.7 | 4.4 | 13.1 | 0.9 | 2.9 | 3.3 | 0.9 | 0.7 | 2.3 | 58.7 | 7.3 | 20.5 |
| Y9510 | 3.6 | 35.1 | 2.5 | 0.5 | 2.7 | 4.4 | 11.7 | 0.7 | 2.9 | 3.7 | 0.9 | 0.7 | 2.3 | 58.9 | 7.8 | 20.7 |

Example 7

Generation of *Yarrowia lipolytica* Strain Y8672 to Produce About 61.8% EPA of Total Fatty Acids ["TFAs"] with 26.5% Total Lipid Content The present Example describes the construction of strain Y8672, derived from *Yarrowia lipolytica* ATCC #20362, capable of producing about 61.8% EPA relative to the total lipids with 26.5% total lipid content ["TFAs % DCW"] via Generation of Strain Y8145 to Produce About 48.5% EPA of TFAs Construct pZKL2-5 m89C (FIG. 10; SEQ ID NO:138) was generated to integrate one Δ5 desaturase gene, one Δ9 elongase gene, one Δ8 desaturase gene, and one *Y. lipolytica* diacylglycerol cholinephosphotransferase gene (CPT1) into the Lip2 loci (GenBank Accession No. AJ012632) of strain Y8069U3 (Example 3) to thereby enable higher level production of EPA. The pZKL2-5m89C plasmid contained the following components:

TABLE 17

Description of Plasmid pZKL2-5m89C (SEQ ID NO: 138)

| RE Sites And Nucleotides Within SEQ ID NO: 138 | Description Of Fragment And Chimeric Gene Components |
|---|---|
| AscI/BsiWI (730-1) | 722 by 5' portion of *Yarrowia* Lip2 gene (labeled as "Lip2.5N" in Figure; GenBank Accession No. AJ012632) |
| PacI/SphI (4141-3438) | 697 by 3' portion of *Yarrowia* Lip2 gene (labeled as "Lip2.3N" in Figure; GenBank Accession No. AJ012632) |
| SwaI/BsiWI (13143-1) | GPD::YlCPT1::Aco, comprising: GPD: *Yarrowia lipolytica* GPD promoter (U.S. Pat. No. 7,259,255); YlCPT1: *Yarrowia lipolytica* diacylglycerol cholinephosphotransferase gene (SEQ ID NO: 37) (Intl. App. Pub. No. WO 2006/052870); Aco: Aco terminator sequence from *Yarrowia* Aco gene (GenBank Accession No. AJ001300) |
| PmeI/SwaI (10506-13143) | FBAIN::EgD8M::Lip1 comprising: FBAIN: *Yarrowia lipolytica* FBAIN promoter (U.S. Pat. No. 7,202,356); EgD8M: Synthetic mutant Δ8 desaturase (SEQ ID NO: 59; U.S. Pat. No. 7,709,239), derived from *Euglena gracilis* ("EgD8S"; U.S. Pat. No. 7,256,033); Lip1: Lip1 terminator sequence from *Yarrowia* Lip1 gene (GenBank Accession No. Z50020) |
| PmeI/ClaI (10506-8650) | YAT1::EgD9eS::Lip2, comprising: YAT1: *Yarrowia lipolytica* YAT1 promoter (labeled as "YAT" in Figure; U.S. Pat. Appl. Pub. No. 2006-0094102-A1); EgD9eS: codon-optimized Δ9 elongase gene (SEQ ID NO: 45), derived from *Euglena gracilis* (U.S. Pat. No. 7,645,604); |

TABLE 17-continued

Description of Plasmid pZKL2-5m89C (SEQ ID NO: 138)

| RE Sites And Nucleotides Within SEQ ID NO: 138 | Description Of Fragment And Chimeric Gene Components |
|---|---|
| | Lip2: Lip2 terminator sequence from *Yarrowia* Lip2 gene (GenBank Accession No. AJ012632) |
| ClaI/EcoRI (8650-6581) | *Yarrowia* Ura3 gene (GenBank Accession No. AJ306421) |
| EcoRI/PacI (6581-4141) | YAT1::EgD5SM::ACO, comprising:<br>YAT1: *Yarrowia lipolytica* YAT1 promoter (labeled as "YAT" in Figure; U.S. Pat. Appl. Pub. No. 2006-0094102-A1);<br>EgD5SM: Synthetic mutant Δ5 desaturase (SEQ ID NO: 71; U.S. Pat. Pub. No. 2010-0075386-A1), derived from *Euglena gracilis* (U.S. Pat. No. 7,678,560);<br>Aco: Aco terminator sequence from *Yarrowia* Aco gene (GenBank Accession No. AJ001300) |

The pZKL2-5m89C plasmid was digested with AscI/SphI, and then used for transformation of strain Y8069U3 according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that most of the selected 96 strains produced 38-44.5% EPA of TFAs. Four strains (i.e., #10, #50, #70 and #89) that produced about 45.1%, 45.6%, 45.0% and 45.6% EPA of TFAs were designated as Y8143, Y8144, Y8145 and Y8146, respectively. Knockout of the Lip2 loci (GenBank Accession No. AJ012632) was not confirmed in these EPA strains.

The final genotype of strains Y8143, Y8144, Y8145 and Y8146 with respect to wildtype *Yarrowia lipolytica* ATCC #20362 was Ura+, Pex3−, unknown 1−, unknown 2−, unknown 3−, unknown 4−, unknown 5−, Leu+, Lys+, YAT1::ME3S::Pex16, GPD::FmD12::Pex20, YAT1::FmD12::Oct, GPAT::EgD9e::Lip2, FBAINm::EgD9eS::Lip2, EXP1::EgD9eS::Lip1, YAT1::EgD9eS::Lip2, FBAINm::EgD8M::Pex20, FBAIN::EgD8M::Lip1, EXP1::EgD8M::Pex16, FBAIN::EgD5SM::Pex20, YAT1::EgD5SM::Aco, EXP1::EgD5M::Pex16, YAT1::EaD5SM::Oct, YAT1::PaD17S::Lip1, EXP1::PaD17::Pex16, FBAINm::PaD17::Aco, GPD::YICPT1::Aco.

Analysis of Total Lipid Content and Composition by Flask Assay

Cells from YPD plates of strains Y8143, Y8144, Y8145 and Y8146 were grown and analyzed for total lipid content and composition, according to the General Methods.

Generation of Strain Y8145U (Ura3−)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8145 in a manner similar to that described for pZKUM transformation of strain Y8006 (Example 3). A total of 8 transformants were grown and identified to possess a Ura− phenotype.

GC analyses showed that there were 22.5%, 22.6% and 23.4% EPA of TFAs in pZKUM-transformant strains #5, #6 and #7, respectively. These three strains were designated as strains Y8145U1, Y8145U2 and Y8145U3, respectively (collectively, Y8145U).

Generation of Y8259 Strain to Produce About 53.9% EPA of TFAs

Construct pZKL1-2SR9G85 (Example 3, FIG. 6A; SEQ ID NO:132) was generated to integrate one DGLA synthase gene, one Δ12 desaturase gene and one Δ5 desaturase gene into the Lip1 loci (GenBank Accession No. Z50020) of strain Y8145U to thereby enable higher level production of EPA.

The pZKL1-2SR9G85 plasmid was digested with AscI/SphI, and then used for transformation of strain Y8145U1, in a manner similar to that described for pZKL1-2SR9G85 transformation of strain Y8154U1 (Example 3). The cells were subjected to fatty acid analysis, according to the General Methods.

GC analyses showed that most of the selected 96 strains produced 40-44.0% EPA of total lipids. Five strains (i.e., #7, #14, #48, #56 and #60) that produced about 45.2%, 47%, 44.4%, 44.3% and 45.2% EPA of TFAs were designated as Y8255, Y8256, Y8257, Y8258 and Y8259, respectively. Knockout of the Lip1 loci (GenBank Accession No. Z50020) was not confirmed in these EPA strains.

TABLE 18

Total Lipid Content And Composition In *Yarrowia* Strains Y8143, Y8144, Y8145 and Y8146 By Flask Assay

| Strain | DCW (g/L) | TFAs % DCW | 16:0 | 16:1 | 18:0 | 18:1 | 18:2 | ALA | EDA | DGLA | ARA | EtrA | ETA | EPA | other | EPA % DCW |
|---|---|---|---|---|---|---|---|---|---|---|---|---|---|---|---|---|
| Y8143 | 4.6 | 22.3 | 4.2 | 1.5 | 1.4 | 3.6 | 18.1 | 2.6 | 1.7 | 1.6 | 0.6 | 2.2 | 1.6 | 50.3 | 11.6 | 11.2 |
| Y8144 | 4.3 | 23 | 4.0 | 1.5 | 1.4 | 3.3 | 18.0 | 2.6 | 1.8 | 1.7 | 0.7 | 2.3 | 1.6 | 50.6 | 11.5 | 11.6 |
| Y8145 | 4.6 | 23.1 | 4.3 | 1.7 | 1.4 | 4.8 | 18.6 | 2.8 | 2.2 | 1.5 | 0.6 | 2.2 | 1.5 | 48.5 | 9.9 | 11.2 |
| Y8146 | 4.5 | 23.8 | 4.3 | 1.7 | 1.4 | 4.8 | 18.7 | 2.8 | 2.0 | 1.5 | 0.6 | 2.2 | 1.5 | 48.3 | 11.2 | 11.5 |

The final genotype of these strains with respect to wildtype *Yarrowia lipolytica* ATCC #20362 was Ura+, Pex3−, unknown 1−, unknown 2−, unknown 3−, unknown 4−, unknown 5−, unknown 6−, Leu+, Lys+, YAT1::ME3S::Pex16, GPD::FmD12::Pex20, YAT1::FmD12::Oct, EXP1::FmD12S::ACO, GPAT::EgD9e::Lip2, FBAINm::EgD9eS::Lip2, EXP1::EgD9eS::Lip1, YAT1::EgD9eS::Lip2, FBAINm::EgD8M::Pex20, FBAIN::EgD8M::Lip1, EXP1::EgD8M::Pex16, YAT1::E389S/EgD8M::Lip1, FBAIN::EgD5SM::Pex20, YAT1::EgD5SM::Aco, GPM::EgD5SM::Oct, EXP1::EgD5M::Pex16, YAT1::EaD5SM::Oct; YAT1::PaD17S::Lip1, EXP1::PaD17::Pex16, FBAINm::PaD17::Aco, GPD::YICPT1::Aco.

*Yarrowia lipolytica* strain Y8259 was deposited with the American Type Culture Collection on May 14, 2009 and bears the designation ATCC PTA-10027.

Analysis of Total Lipid Content and Composition by Flask Assay

Cells from YPD plates of strains Y8256 and Y8259 were grown and analyzed for total lipid content and composition, according to the General Methods.

TABLE 19

Total Lipid Content And Composition In *Yarrowia* Strains Y8256 and Y8259 By Flask Assay

| Strain | DCW (g/L) | TFAs % DCW | 16:0 | 16:1 | 18:0 | 18:1 | 18:2 | ALA | EDA | DGLA | ARA | EtrA | ETA | EPA | other | EPA % DCW |
|---|---|---|---|---|---|---|---|---|---|---|---|---|---|---|---|---|
| Y8256 | 4.0 | 20.1 | 3.5 | 1.4 | 1.3 | 3.8 | 18.8 | 2.0 | 2.1 | 1.6 | 0.8 | 2.1 | 1.7 | 49.9 | 11.0 | 10.0 |
| Y8259 | 4.7 | 20.5 | 3.5 | 1.3 | 1.3 | 4.8 | 16.9 | 2.3 | 1.9 | 1.7 | 0.6 | 1.8 | 1.6 | 53.9 | 8.4 | 11.0 |

Generation of Strain Y8259U (Ura3−)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8259 in a manner similar to that described for pZKUM transformation of strain Y8006 (Example 3). A total of 8 transformants were grown and identified to possess a Ura− phenotype.

GC analyses showed that there was 26.6% EPA of TFAs in pZKUM-transformant strain #3. This strain was designated as strain Y8259U.

Generation of Y8367 Strain to Produce About 58.3% EPA of TFAs

Construct pZP2-85 m98F (Example 5, FIG. 7B; SEQ ID NO:135) was generated to integrate one Δ8 desaturase gene, one DGLA synthase, and one Δ5 desaturase gene into the *Yarrowia* Pox2 locus (GenBank Accession No. AJ001300) of strain Y8259U to thereby enable higher level production of EPA.

The pZP2-85 m98F plasmid was digested with AscI/SphI, and then used for transformation of strain Y8259U, in a manner similar to that described for pZP2-85 m98F transformation of strain Y8647U3 (Example 5). The cells were subjected to fatty acid analysis, according to the General Methods.

GC analyses showed that most of the selected 96 strains of Y8259U with pZP2-85 m98F produced 41-46% EPA of TFAs. Four strains (i.e., #26, #33, #77 and #81) that produced about 46.7%, 46.5%, 47.4% and 46.9% EPA of TFAs were designated as Y8367, Y8368, Y8369 and Y8370, respectively. Knock out of the Pox2 locus (GenBank Accession No. AJ001300) was not confirmed in these EPA strains.

The final genotype of strains Y8367, Y8368, Y8369 and Y8370 with respect to wildtype *Yarrowia lipolytica* ATCC #20362 was Ura+, Pex3−, unknown 1−, unknown 2−, unknown 3−, unknown 4−, unknown 5−, unknown 6−, unknown 7−, Leu+, Lys+, YAT1::ME3S::Pex16, GPD::FmD12::Pex20, YAT1::FmD12::Oct, EXP1::FmD12S::ACO, GPAT::EgD9e::Lip2, FBAINm::EgD9eS::Lip2, EXP1::EgD9eS::Lip1, YAT1::EgD9eS::Lip2, FBAINm::EgD8M::Pex20, FBAIN::EgD8M::Lip1, EXP1::EgD8M::Pex16, GPD::EaD8S::Pex16, YAT1::E389D9eS/EgD8M::Lip1, YAT1::EgD9eS/EgD8M::Aco, FBAIN::EgD5SM::Pex20, YAT1::EgD5SM::Aco, GPM::EgD5SM::Oct, EXP1::EgD5M::Pex16, EXP1::EgD5SM::Lip1, YAT1::EaD5SM::Oct, YAT1::PaD17S::Lip1, EXP1::PaD17::Pex16, FBAINm::PaD17::Aco, GPD::YICPT1::Aco.

Analysis of Total Lipid Content and Composition by Flask Assay

Cells from YPD plates of strains Y8367, Y8368, Y8369 and Y8370 were grown and analyzed for total lipid content and composition, according to the General Methods.

TABLE 20

Total Lipid Content And Composition In *Yarrowia* Strains Y8367, Y8368, Y8369 and Y8370 By Flask Assay

| Strain | DCW (g/L) | TFAs % DCW | 16:0 | 16:1 | 18:0 | 18:1 | 18:2 | ALA | EDA | DGLA | ARA | EtrA | ETA | EPA | other | EPA % DCW |
|---|---|---|---|---|---|---|---|---|---|---|---|---|---|---|---|---|
| Y8367 | 3.6 | 18.4 | 3.7 | 1.2 | 1.1 | 3.4 | 14.2 | 1.1 | 1.5 | 1.7 | 0.8 | 2.1 | 1.0 | 58.3 | 9.9 | 10.7 |
| Y8368 | 4.7 | 19.2 | 3.0 | 1.4 | 1.3 | 4.3 | 17.9 | 1.3 | 2.4 | 2.8 | 1.0 | 1.8 | 1.9 | 52.5 | 8.4 | 10.1 |
| Y8369 | 3.5 | 19.7 | 3.7 | 1.2 | 1.6 | 4.2 | 15.6 | 1.8 | 1.7 | 1.9 | 0.6 | 1.7 | 1.6 | 55.8 | 8.6 | 11.0 |
| Y8370 | 4.0 | 23.3 | 3.4 | 1.1 | 1.4 | 4.0 | 15.7 | 1.9 | 1.7 | 1.9 | 0.6 | 1.8 | 1.5 | 56.4 | 8.6 | 13.1 |

Generation of Strain Y8367U (Ura3−)

In order to disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8367 in a manner similar to that described for pZKUM transformation of strain Y8006 (Example 3). A total of 8 transformants were grown and identified to possess a Ura− phenotype.

GC analyses showed that there were 25.6%, 25.5% and 25.4% EPA of TFAs in pZKUM-transformant strains #2, #3 and #6, respectively. These three strains were designated as strains Y8367U1, Y8367U2 and Y8367U3, respectively (collectively, Y8367U).

Generation of Y8672 strain to Produce About 61.8% EPA of TFAs

Construct pZSCP-Ma83 (Example 3, FIG. 6B; SEQ ID NO:133) was generated to integrate one Δ8 desaturase gene, one $C_{16/18}$ elongase gene and one malonyl-CoA synthetase gene into the SCP2 loci (GenBank Accession No. XM_503410) of strain Y8637U to thereby enable higher level production of EPA.

The pZSCP-Ma83 plasmid was digested with AscI/SphI, and then used for transformation of strain Y8367U1, in a manner similar to that described for pZSCP-Ma83 transformation of strain Y8269U1 (Example 3). The cells were subjected to fatty acid analysis, according to the General Methods.

GC analyses showed that most of the selected 96 strains of Y8367U1 with pZSCP-Ma83 produced 46-52.5% EPA of TFAs. Eight strains (i.e., #8, #40, #43, #44, #61, #63, #68 and #70) that produced about 53.2%, 52.8%, 52.7%, 52.9%, 53.0%, 52.6%, 53.1% and 52.7% EPA of TFAs were designated as Y8666, Y8667, Y8668, Y8669, Y8670, Y8671, Y8672 and Y8673, respectively. Knockout of the SCP2 loci (Gen Bank Accession No. XM_503410) was not confirmed in these EPA strains.

The final genotype of strains Y8666, Y8667, Y8668, Y8669, Y8670, Y8671, Y8672 and Y8673 with respect to wildtype *Yarrowia lipolytica* ATCC #20362 was Ura+, Pex3−, unknown 1−, unknown 2−, unknown 3−, unknown 4−, unknown 5−, unknown 6−, unknown 7−, unknown 8−, Leu+, Lys+, YAT1::ME3S::Pex16, GPD::ME3S::Pex20, GPD::FmD12::Pex20, YAT1::FmD12::Oct, EXP1::FmD12S::ACO, GPAT::EgD9e::Lip2, FBAINm::EgD9eS::Lip2, EXP1::EgD9eS::Lip1, YAT1::EgD9eS::Lip2, FBAINm::EgD8M::Pex20, FBAIN::EgD8M::Lip1, EXP1::EgD8M::Pex16, GPD::EaD8S::Pex16 (2 copies), YAT1::E389D9eS/EgD8M::Lip1, YAT1::EgD9eS/EgD8M::Aco, FBAIN::EgD5SM::Pex20, YAT1::EgD5SM::Aco, GPM::EgD5SM::Oct, EXP1::EgD5M::Pex16, EXP1::EgD5SM::Lip1, YAT1::EaD5SM::Oct, YAT1::PaD17S::Lip1, EXP1::PaD17::Pex16, FBAINm::PaD17::Aco, GPD::YlCPT1::Aco, YAT1::MCS::Lip1.

Analysis of Total Lipid Content and Composition by Flask Assay

Cells from YPD plates of strains Y8666, Y8669, Y8679 and Y8672 were grown and analyzed for total lipid content and composition, according to the General Methods.

TABLE 21

Total Lipid Content And Composition In *Yarrowia* Strains Y8666, Y8669, Y8670 And Y8672 By Flask Assay

| Strain | DCW (g/L) | TFAs % DCW | 16:0 | 16:1 | 18:0 | 18:1 | 18:2 | ALA | EDA | DGLA | ARA | EtrA | ETA | EPA | other | EPA % DCW |
|---|---|---|---|---|---|---|---|---|---|---|---|---|---|---|---|---|
| Y8666 | 3.2 | 25.2 | 2.3 | 0.3 | 2.3 | 4.1 | 15.1 | 1.3 | 1.7 | 1.4 | 0.7 | 0.6 | 1.3 | 62.2 | 6.7 | 15.6 |
| Y8669 | 3.2 | 26.4 | 2.3 | 0.3 | 2.3 | 4.1 | 15.7 | 1.4 | 1.8 | 1.6 | 0.7 | 0.5 | 1.1 | 61.5 | 6.7 | 16.3 |
| Y8670 | 3.2 | 27.3 | 1.9 | 0.4 | 3.4 | 4.3 | 17.0 | 1.5 | 2.2 | 1.7 | 0.6 | 0.5 | 1.1 | 60.9 | 4.5 | 16.6 |
| Y8672 | 3.3 | 26.5 | 2.3 | 0.4 | 2.0 | 4.0 | 16.1 | 1.4 | 1.8 | 1.6 | 0.7 | 0.4 | 1.1 | 61.8 | 6.4 | 16.4 |

Example 8

Construction of Various Expression Vectors Comprising Different LPLAT ORFs

The present example describes the construction of a series of vectors, each comprising a LPLAT ORF, suitable for expression in *Yarrowia lipolytica*. LPLAT ORFs included the *Saccharomyces cerevisiae* Ale1, *Yarrowia lipolytica* Ale1, *Mortierella alpina* LPAAT1, *Yarrowia lipolytica* LPAAT1 and *Caenorhabditis elegans* LPCAT. Example 9 describes the results obtained following transformation of these vectors into *Yarrowia lipolytica* strain Y8406U.

Origin of LPLATs

A variety of LPLATs have been identified in the patent and open literature, but the functionality of these genes has not been previously directly compared. Table 22 summarizes publicly available LPLATs (i.e., ScAle1, ScLPAAT, MaLPAAT1 and CeLPCAT) and LPLAT orthologs identified herein (i.e., YlAle1 and YlLPAAT1) that are utilized in the present Example, following codon-optimization of heterologous genes for expression in *Yarrowia lipolytica* (infra).

TABLE 22

LPLATs Functionally Characterized

| LPLAT | Organism | ORF Designation | References | SEQ ID NO |
|---|---|---|---|---|
| Ale1 | *Saccharomyces cerevisiae** | ORF "YOR175C" or "ScAle1" | GenBank Accession No. NP_014818; U.S. Pat. Appl. Pub. No. 20080145867 (and corresponding to Intl. App. Pub. No. WO 2008/076377); Intl. App. Pub. No. WO 2009/001315 | 14, 15 |

TABLE 22-continued

LPLATs Functionally Characterized

| LPLAT | Organism | ORF Designation | References | SEQ ID NO |
|---|---|---|---|---|
| | Yarrowia lipolytica | "YALI0F19514p" or "YIAle1" | GenBank Accession No. XP_505624; Intl. App. Pub. No. WO 2009/001315 | 16, 17 |
| LPAAT | Saccharomyces cerevisiae | ORF "YDL052C" or "ScLPAAT" | GenBank Accession No. NP_010231 | 32 |
| | Mortierella alpina | "MaLPAAT1" | U.S. Pat. Appl. Pub. No. 2006-0115881-A1; U.S. Pat. Appl. Pub. No. 2009-0325265-A1 | 28, 29 |
| | Yarrowia lipolytica | "YALI0E18964g" or "YILPAAT1" | GenBank Accession No. XP_504127; U.S. Pat. No. 7,189,559 | 30, 31 |
| LPCAT | Caenorhabditis elegans* | "clone T06E8.1" or "CeLPCAT" | GenBank Accession No. CAA98276; Intl. App. Pub. No. WO 2004/076617 (corresponding to U.S. Pat. Appl. Pub. No. 2006-0168687-A1) | 24, 25 |

*The Saccharomyces cerevisiae Ale1 and Caenorhabditis elegans LPCAT were used as comparative Examples.

More specifically, the ScLPAAT (SEQ ID NO:32) and ScAle1 (SEQ ID NO:15) protein sequences were used as queries to identify orthologs from the public *Y. lipolytica* protein database of the "Yeast project *Genolevures*" (Center for Bioinformatics, LaBR1, Talence Cedex, France) (see also Dujon, B. et al., *Nature,* 430(6995):35-44 (2004)). Based on analysis of the best hits, the Ale1 and LPAAT orthologs from *Yarrowia lipolytica* are identified herein as YIAle1 (SEQ ID NO:17) and YILPAAT (SEQ ID NO:31), respectively. The identity of YIAle1 and YILPAAT1 as orthologs of ScAle1 and ScLPAAT, respectively, was further confirmed by doing a reciprocal BLAST, i.e., using SEQ ID NOs:17 and 31 as a query against the *Saccharomyces cerevisiae* public protein database to find ScAle1 and ScLPAAT, respectively, as the best hits.

The LPLAT proteins identified above as ScAle1 (SEQ ID NO:15), YIAle1 (SEQ ID NO:17), ScLPAAT (SEQ ID NO:32), MaLPAAT1 (SEQ ID NO:29), YILPAAT1 (SEQ ID NO:31) and CeLPCAT (SEQ ID NO:25) were aligned using the method of Clustal W (slow, accurate, Gonnet option; Thompson et al., *Nucleic Acids Res.,* 22:4673-4680 (1994)) of the MegAlign™ program (version 8.0.2) of the LASERGENE bioinformatics computing suite (DNASTAR, Inc., Madison, Wis.). This resulted in creation of Table 23, where percent similarity is shown in the upper triangle of the Table while percent divergence is shown in the lower triangle.

The percent identities revealed by this method allowed determination of the minimum percent identity between each of the LPAAT polypeptides and the minimum percent identity between each of the Ale1 polypeptides. The range of identity between LPAAT polypeptides was 34.0% identity (MaLPAAT1 and YILPAAT1) to 43.9% identity (ScLPAAT and YILPAAT1), while identity between the ScAle1 and YIAle1 polypeptides was 45%.

Membrane Bound O-Acyltransferase ["MBOAT"] Family Motifs: Orthologs of the ScAle1 protein sequence (SEQ ID NO:15) were identified by conducting a National Center for Biotechnology Information ["NCBI"]BLASTP 2.2.20 (protein-protein Basic Local Alignment Search Tool; Altschul et al., *Nucleic Acids Res.,* 25:3389-3402 (1997); and Altschul et al., *FEBS J.,* 272:5101-5109 (2005)) search using ScAle1 (SEQ ID NO:15) as the query sequence against fungal proteins in the "nr" protein database (comprising all non-redundant GenBank CDS translations, sequences derived from the 3-dimensional structure from Brookhaven Protein Data Bank ["PDB"], sequences included in the last major release of the SWISS-PROT protein sequence database, PIR and PRF excluding those environmental samples from WGS projects) using default parameters (expect threshold=10; word size=3; scoring parameters matrix=BLOSUM62; gap costs: existence=11, extension=1). The following hits were obtained:

TABLE 23

Percent Identity And Percent Divergence Among Various LPLATs

| YILPAAT1 | CeLPCAT | MaLPAAT1 | ScAle1 | ScLPAAT | YIAle1 | |
|---|---|---|---|---|---|---|
| — | 26.6 | 34.0 | 9.6 | 43.9 | 11.7 | YILPAAT1 |
| 184.3 | — | 36.4 | 11.3 | 32.4 | 14.5 | CeLPCAT |
| 137.5 | 126.4 | — | 11.1 | 34.6 | 15.0 | MaLPAAT1 |
| 545.0 | 442.0 | 456.0 | — | 13.5 | 45.0 | ScAle1 |
| 97.9 | 145.7 | 134.5 | 365.0 | — | 15.6 | ScLPAAT |
| 426.0 | 339.0 | 330.0 | 94.3 | 317.0 | — | YIAle1 |

TABLE 24

Fungal Orthologs Of ScAle1 (SEQ ID NO: 15) Based On BLAST Analysis

| Gen Bank Acession No. | Species |
|---|---|
| NP_014818.1 | Saccharomyces cerevisiae |
| XP_001643411.1 | Vanderwaltozyma polyspora DSM 70294 |
| XP_448977.1 | Candida glabrata |
| XP_455985.1 | Kluyveromyces lactis |
| NP_986937.1 | Ashbya gossypii ATCC 10895 |
| XP_001385654.2 | Pichia stipitis CBS 6054 |
| XP_001487052.1 | Pichia guilliermondii ATCC 6260 |
| EDK36331.2 | Pichia guilliermondii ATCC 6260 |
| XP_001525914.1 | Lodderomyces elongisporus NRRL YB-4239 |
| XP_461358.1 | Debaryomyces hansenii CBS767 |
| XP_713184.1 | Candida albicans SC5314 |
| XP_001645053.1 | Vanderwaltozyma polyspora DSM 70294 |
| XP_505624.1 | Yarrowia lipolytica |
| XP_001805526.1 | Phaeosphaeria nodorum SN15 |
| XP_001598340.1 | Sclerotinia sclerotiorum 1980 |
| XP_001907785.1 | Podospora anserina |
| XP_001931658.1 | Pyrenophora tritici-repentis Pt-1C-BFP |
| XP_001560657.1 | Botryotinia fuckeliana B05.10 |
| XP_963006.1 | Neurospora crassa OR74A |
| XP_364011.2 | Magnaporthe grisea 70-15 |
| XP_001209647.1 | Aspergillus terreus NIH2624 |
| XP_001822945.1 | Aspergillus oryzae RIB40 |
| XP_001257694.1 | Neosartorya fischeri NRRL 181 |
| XP_747591.2 | Aspergillus fumigatus Af293 |
| XP_001270060.1 | Aspergillus clavatus NRRL 1 |
| NP_596779.1 | Schizosaccharomyces pombe |
| XP_001396584.1 | Aspergillus niger |
| XP_001229385.1 | Chaetomium globosum CBS 148.51 |
| XP_001248887.1 | Coccidioides immitis RS |
| XP_664134.1 | Aspergillus nidulans FGSC A4 |
| XP_566668.1 | Cryptococcus neoformans var. neoformans JEC21 |
| XP_001839338.1 | Coprinopsis cinerea okayama 7#130 |
| XP_757554.1 | Ustilago maydis 521 |

The yeast and fungal protein sequences of Table 24 were aligned using DNASTAR. Multiple sequence alignments and percent identity calculations were performed using the Clustal W method of alignment (supra).

More specifically, default parameters for multiple protein alignment using the Clustal W method of alignment correspond to: GAP PENALTY=10, GAP LENGTH PENALTY=0.2, Delay Divergent Seqs(%)=30, DNA Transition Weight=0.5, Protein Weight Matrix=Gonnet Series, DNA Weight Matrix=IUB with the 'slow-accurate' option. The resulting alignment was analyzed to determine the presence or absence of the non-plant motifs for Ale1 homologs, as identified in U.S. Pat. Appl. Pub. No. 2008-0145867-A1. Specifically, these include: M-[V/I]-[L/I]-xxK-[L/V/I]-xxxxxxDG (SEQ ID NO:102), RxKYYxxWxxx-[E/D]-[A/G]xxxxGxG-[F/Y]-xG (SEQ ID NO:103), EX$_{11}$WNX$_2$-[T/V]-X$_2$W (SEQ ID NO:21) and SAxWHGxxPGYxx-[T/F]-F (SEQ ID NO:104), wherein X encodes any amino acid residue. The His residue in SEQ ID NO:104 has been reported to be a likely active site residue within the protein.

Only one motif, i.e., EX$_{11}$WNX$_2$-[T/V]-X$_2$W (SEQ ID NO:21), was completely conserved in all 33 of the organisms aligned. The remaining M-[V/I]-[L/I]-xxK-[L/V/I]-xxxxxxDG (SEQ ID NO:102), RxKYYxxWxxx-[E/D]-[A/G]xxxxGxG-[F/Y]-xG (SEQ ID NO:103) and SAxWHGxx-PGYxx-[T/F]-F (SEQ ID NO:104) motifs were only partially conserved. Thus, these motifs were appropriately truncated to fit with 0 mismatch (i.e., SAxWHG [SEQ ID NO:20]), 1 mismatch (i.e., RxKYYxxW [SEQ ID NO:19]), or 2 mismatches (i.e., M(V/I)(L/I)xxK(LVI) [SEQ ID NO:18]) for the purposes of the present methodologies.

1-Acyl-sn-Glycerol-3-Phosphate Acyltransferase ["LPAAT"] Family Motifs: Analysis of the protein alignment comprising ScLPAAT (SEQ ID NO:18), MaLPAAT1 (SEQ ID NO:15) and YlLPAAT1 (SEQ ID NO:17) revealed that the 1-acyl-sn-glycerol-3-phosphate acyltransferase family motif EGTR (SEQ ID NO:20) was present in each of the LPAAT orthologs. On this basis, MaLPAAT1 was identified as a likely LPAAT, that was clearly distinguishable from the Mortierella alpina LPAAT-like proteins disclosed in Intl. App. Pub. No. WO 2004/087902 (i.e., SEQ ID NOs:93 and 95).

It is noteworthy that the EGTR (SEQ ID NO:20) motif, while lacking in the LPCAT sequences in Intl. App. Pub. No. WO 2004/087902, is present in CeLPCAT (SEQ ID NO:2). It appears that other residues distinguish LPAAT and LPCAT sequences in LPAAT-like proteins. One such residue could be the extension of the EGTR (SEQ ID NO:20) motif. Specifically, whereas the EGTR motif in ScLPAAT (SEQ ID NO:18), MaLPAAT1 (SEQ ID NO:15) and YlLPAAT1 (SEQ ID NO:17) is immediately followed by a serine residue, the EGTR motif in CeLPCAT is immediately followed by an asparagine residue. In contrast, the two LPCATs in Intl. App. Pub. No. WO 2004/087902 have a valine substituted for the arginine residue in the EGTR motif and the motif is immediately followed by a valine residue.

Construction of pY201, Comprising a Codon-Optimized Saccharomyces cerevisiae Ale1 Gene The Saccharomyces cerevisiae ORF designated as "ScAle1" (SEQ ID NO:14) was optimized for expression in Yarrowia lipolytica, by DNA 2.0 (Menlo Park, Calif.). In addition to codon optimization, 5' Pci1 and 3' Not1 cloning sites were introduced within the synthetic gene (i.e., ScAle1S; SEQ ID NO:22). None of the modifications in the ScAle1S gene changed the amino acid sequence of the encoded protein (i.e., the protein sequence encoded by the codon-optimized gene [i.e., SEQ ID NO:23] is identical to that of the wildtype protein sequence [i.e., SEQ ID NO:15]). ScAle1S was cloned into pJ201 (DNA 2.0) to result in pJ201:ScAle1S.

Figure 10A:
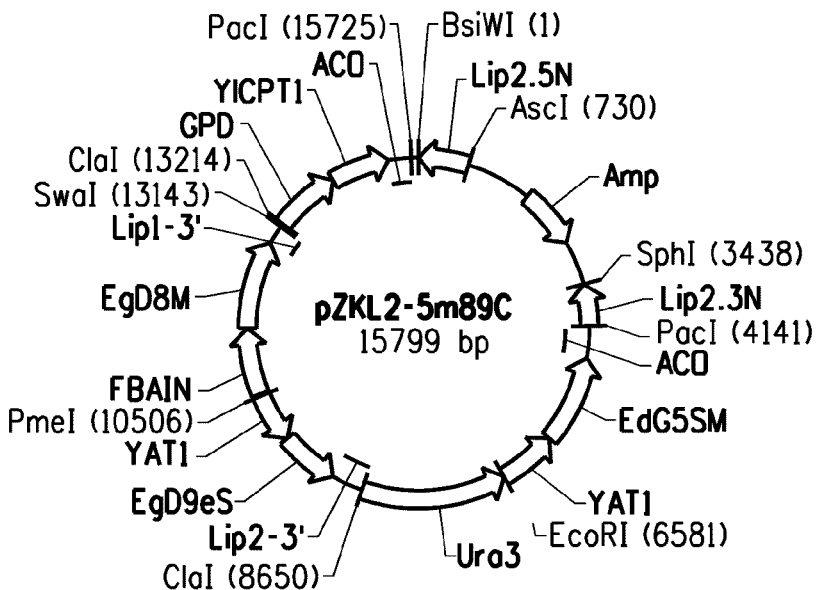
Figure 10B:
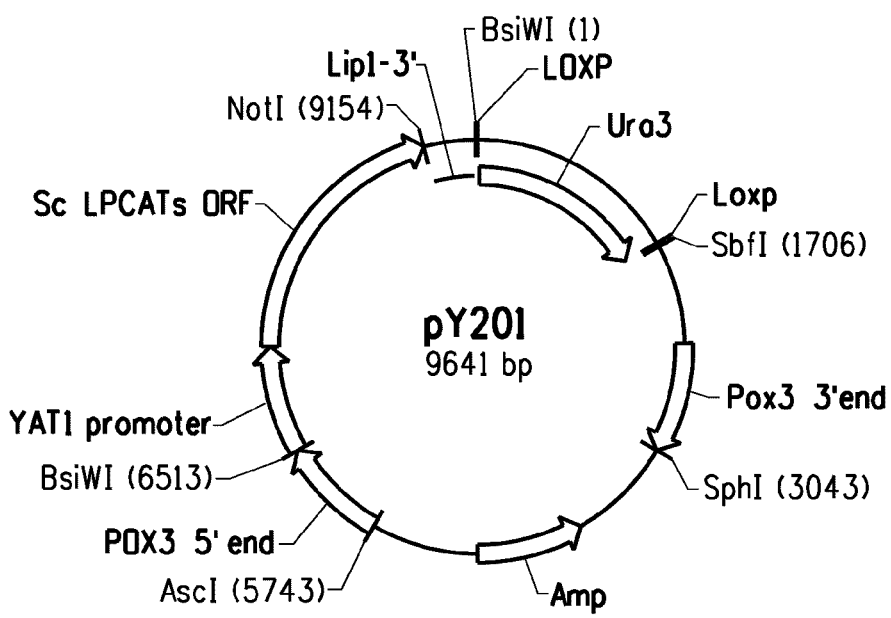

A 1863 by Pci1/Not1 fragment comprising ScAle1S was excised from pJ201:ScAle1S and used to create pY201 (SEQ ID NO:139; Table 25; FIG. 10A). In addition to comprising a chimeric YAT1::ScAle1S::Lip1 gene, pY201 also contains a Y. lipolytica URA3 selection marker flanked by LoxP sites for subsequent removal, if needed, by Cre recombinase-mediated recombination. Both the YAT1::ScAle1S::Lip1 chimeric gene and the URA3 gene were flanked by fragments having homology to 5' and 3' regions of the Y. lipolytica Pox3 gene to facilitate integration by double homologous recombination, although integration into Y. lipolytica is known to usually occur without homologous recombination. Thus, construct pY201 thereby contained the following components:

TABLE 25

Description of Plasmid pY201 (SEQ ID NO: 139)

| RE Sites And Nucleotides Within SEQ ID NO: 139 | Description Of Fragment And Chimeric Gene Components |
|---|---|
| BsiWI/SbfI (1-1706 bp) | LoxP::Ura3::LoxP, comprising:<br>LoxP sequence (SEQ ID NO: 140)<br>*Yarrowia lipolytica* Ura3 gene (GenBank Accession No. AJ306421);<br>LoxP sequence (SEQ ID NO: 140) |
| SbfI/SphI (1706-3043 bp) | 3' portion of *Yarrowia lipolytica* POX3 Acyl-CoA oxidase 3 (GenBank Accession No. YALI0D24750g) (i.e., bp 2215-3038 in pY201) |
| SphI/AscI (3043-5743 bp) | ColE1 plasmid origin of replication;<br>Ampicillin-resistance gene (Amp$^R$) for selection in *E. coli* (i.e., bp 3598-4758 [complementary] in pY201);<br>*E. coli* f1 origin of replication |
| AscI/BsiWI (5743-6513 bp) | 5' portion of *Yarrowia lipolytica* POX3 Acyl-CoA oxidase 3 (GenBank Accession No. YALI0D24750g) (i.e., bp 5743-6512 in pY201) |
| BsiWI/BsiWI (6514-1 bp) [a NotI site, located between ScAle1S and Lip1 is present at bp 9154 bp] | YAT1::ScAle1S::Lip1, comprising:<br>YAT1: *Yarrowia lipolytica* YAT1 promoter (U.S. Pat. Appl. Pub. No. 2006/0094102-A1) (i.e., bp 6514-7291 in pY201)<br>ScAle1S: codon-optimized Ale1 (SEQ ID NO: 22) derived from *Saccharomyces cerevisiae* YOR175C (i.e., bp 7292-9151 in pY201; labeled as "Sc LPCATs ORF" in Figure);<br>Lip1: Lip1 terminator sequence from *Yarrowia* Lip1 gene (GenBank Accession No. Z50020) (i.e., bp 9160-9481 pY201; labeled as "Lip1-3'" in Figure) |

Construction of pY168, Comprising a *Yarrowia lipolytica* Ale1 Gene

The *Yarrowia lipolytica* ORF designated as "YlAle1" (GenBank Accession No. XP_505624; SEQ ID NO:16) was amplified by PCR from *Yarrowia lipolytica* ATCC #20362 cDNA library using PCR primers 798 and 799 (SEQ ID NOs:141 and 142, respectively). Additionally, the YAT promoter was amplified by PCR primers 800 and 801 (SEQ ID NOs:143 and 144, respectively) from pY201 (SEQ ID NO:139). Since the primer pairs were designed to create two PCR products having some overlap with one another, a YAT1::YlAle1 fusion fragment was then amplified by overlapping PCR using primers 798 and 801 (SEQ ID NOs:141 and 144, respectively) and the two PCR fragments as template. The PCR was carried out in a RoboCycler Gradient 40 PCR machine (Stratagene) using the manufacturer's recommendations and Pfu Ultra™ High-Fidelity DNA Polymerase (Stratagene, Cat. No. 600380). Amplification was carried out as follows: initial denaturation at 95° C. for 4 min, followed by 30 cycles of denaturation at 95° C. for 30 sec, annealing at 55° C. for 1 min, and elongation at 72° C. for 1 min. A final elongation cycle at 72° C. for 10 min was carried out, followed by reaction termination at 4° C.

The PCR product comprising the YAT1::Yl Ale1 fusion fragment was gel purified and digested with ClaI/NotI. This Cla1-Not1 fragment was ligated into pY201 that had been similarly digested (thereby removing the YAT1::ScAle1S fragment) to create pY168 (SEQ ID NO:145), comprising a chimeric YAT1::YlAle1::Lip1 gene. The DNA sequence of the *Yarrowia* Ale1ORF was confirmed by DNA sequencing. The components present in pY168 (FIG. 10B; SEQ ID NO:145) are identical to those present in pY201, with the exception of the YAT1::YlAle1::Lip1 gene in pY168, instead of the YAT1::ScAle1S::Lip1 gene in pY201 (FIG. 10A). Note that YlAle1 is labeled as "Yl LPCAT" in FIG. 10B.

Construction of pY208, Comprising a *Mortierella alpina* LPAAT1 Gene

The *Mortierella alpina* ORF designated as "MaLPAAT1" (SEQ ID NO:28) was optimized for expression in *Yarrowia lipolytica*, by DNA 2.0 (Menlo Park, Calif.). In addition to codon optimization, 5' Pci1 and 3' Not1 cloning sites were introduced within the synthetic gene (i.e., MaLPAAT1S; SEQ ID NO:35). None of the modifications in the MaLPAAT1S gene changed the amino acid sequence of the encoded protein (i.e., the protein sequence encoded by the codon-optimized gene [i.e., SEQ ID NO:36] is identical to that of the wildtype protein sequence [i.e., SEQ ID NO:29]). MaLPAAT1 S was cloned into pJ201 (DNA 2.0) to result in pJ201:MaLPAAT1S.

A 945 by Pci1/Not1 fragment comprising MaLPAAT1S was excised from pJ201:MaLPAAT1S and used to create pY208 (SEQ ID NO:146), in a 3-way ligation with two fragments of pY201 (SEQ ID NO:139). Specifically, the MaLPAAT1 fragment was ligated with a 3530 by Sph-NotI pY201 fragment and a 4248 by NcoI-SphI pY201 fragment to result in pY208. The components present in pY208 (FIG. 11A; SEQ ID NO:146) are identical to those present in pY201, with the exception of the YAT1::MaLPAAT1S::Lip1 gene in pY208, instead of the YAT1::ScAle1S::Lip1 gene in pY201 (FIG. 10A).

Construction of pY207, Comprising a *Yarrowia lipolytica* LPAAT1 Gene

A putative LPAAT1 from *Yarrowia lipolytica* (designated herein as "YlLPAAT1"; SEQ ID NOs:30 and 31) was described in U.S. Pat. No. 7,189,559 and GenBank Accession No. XP_504127. The protein is annotated as "similar to uniprot|P33333 *Saccharomyces cerevisiae* YDL052c SLC1 fatty acyltransferase".

The YlLPAAT1ORF (SEQ ID NO:30) was amplified by PCR using a *Yarrowia lipolytica* ATCC #20362 cDNA library as a template and PCR primers 856 and 857 (SEQ ID NOs: 147 and 148, respectively). The PCR was conducted using the same components and conditions as described above for amplification of the YAT1::Yl Ale1 fusion fragment, prior to synthesis of pY168.

The PCR product comprising the YlLPAAT1ORF was digested with PciI and NotI and then utilized in a 3-way ligation with two fragments from pY168. Specifically, the YlLPAAT1 fragment was ligated with a 3530 by Sph-NotI pY168 fragment and a 4248 by NcoI-SphI pY168 fragment, to produce pY207, comprising a chimeric YAT1::YlLPAAT1::Lip1 gene. The *Y. lipolytica* LPAAT1ORF was confirmed by DNA sequencing. The components present in pY207 (FIG. 11B; SEQ ID NO:149) are identical to those present in pY201, with the exception of the chimeric YAT1:: YlLPAAT1::Lip1 gene in pY207, instead of the YAT1:: ScAle1S::Lip1 gene in pY201 (FIG. 10A). Note that YlLPAAT1 is labeled as "YI LPAT1 ORF" in FIG. 11B.

Construction of pY175, Comprising a *Caenorhabditis elegans* LPCAT Gene

The *Caenorhabditis elegans* ORF designated as "CeLPCAT" (SEQ ID NO:24) was optimized for expression in *Yarrowia lipolytica*, by GenScript Corporation (Piscataway, N.J.). In addition to codon optimization, 5' Nco1 and 3' Not1 cloning sites were introduced within the synthetic gene (i.e., CeLPCATS; SEQ ID NO:26). None of the modifications in the CeLPCATS gene changed the amino acid sequence of the encoded protein (i.e., the protein sequence encoded by the codon-optimized gene [i.e., SEQ ID NO:27] is identical to that of the wildtype protein sequence [i.e., SEQ ID NO:25]).

A Nco1-Not1 fragment comprising CeLPCATS was used to create pY175 (SEQ ID NO:150), in a 3-way ligation with two fragments from pY168 (SEQ ID NO:145). Specifically, the Nco1-Not1 fragment comprising CeLPCATS was ligated with a 3530 by Sph-NotI pY168 fragment and a 4248 by NcoI-SphI pY168 fragment to result in pY175. The components present in pY175 (FIG. 12A; SEQ ID NO:150) are identical to those present in pY201, with the exception of the YAT1::CeLPCATS::Lip1 gene in pY175, instead of the YAT1::ScAle1S::Lip1 gene in pY201 (FIG. 10A). Note that CeLPCATS is labeled as "Ce.LPCATsyn" in FIG. 12A.

Example 9

Functional Characterization of Different LPLATs in EPA-Producing *Yarrowia lipolytica* Strain Y8406

*Yarrowia lipolytica* strain Y8406U, producing EPA, was used to functionally characterize the effects of overexpression of the *Saccharomyces cerevisiae* Ale1, *Yarrowia lipolytica* Ale1, *Mortierella alpina* LPAAT1, *Yarrowia lipolytica* LPAAT1 and *Caenorhabditis elegans* LPCAT, following their stable integration into the *Yarrowia* host chromosome. This was in spite of the host containing its native LPLATs, i.e., Ale1 and LPAAT1.

Transformation and Growth

To disrupt the Ura3 gene, construct pZKUM (FIG. 5A; SEQ ID NO:130; described in Table 15 of U.S. Pat. Appl. Pub. No. 2009-0093543-A1) was used to integrate a Ura3 mutant gene into the Ura3 gene of strain Y8406 in a manner similar to that described for pZKUM transformation of strain Y8006 (Example 3). Several transformants were grown and identified to possess a Ura– phenotype.

GC analyses showed that there were 26.1% EPA of FAMEs in pZKUM-transformant strains #4 and #5. These two strains were designated as strains Y8406U1 and Y8406U2, respectively (collectively, Y8406U).

*Yarrowia lipolytica* strain Y8406U was then individually transformed with linear SphI-AscI fragments of the integrating vectors described in Example 8, wherein each LPLAT was under the control of the *Yarrowia* YAT1 promoter. Specifically, vectors pY201 (YAT1::ScAle1S::Lip1), pY168 (YAT1::YlAle1::Lip1), pY208 (YAT1::MaLPAAT1S::Lip1), pY207 (YAT1::YlLPAAT1::Lip1) and pY175 (YAT1::CeLPCATS::Lip1) were transformed according to the General Methods.

Each transformation mix was plated on MM agar plates. Several resultant URA+ transformants were picked and inoculated into 3 mL FM medium (Biomyx Cat. No. CM-6681, Biomyx Technology, San Diego, Calif.) containing per L: 6.7 g Difco Yeast Nitrogen Base without amino acids, 5 g Yeast Extract, 6g $KH_2PO_4$, 2g $K_2HPO_4$, 1.5 g $MgSO_4.7H_2O$, 1.5 mg thiamine.HCl, and 20g glucose. After 2 days growth on a shaker at 200 rpm and 30° C., the cultures were harvested by centrifugation and resuspended in 3 mL HGM medium (Cat. No. 2G2080, Teknova Inc., Hollister, Calif.) containing 0.63% monopotassium phosphate, 2.7% dipotassium phosphate, 8.0% glucose, adjusted to pH 7.5. After 5 days growth on a shaker at 200 rpm and at 30° C., 1 mL aliquots of the cultures were harvested by centrifugation and analyzed by GC. Specifically, the cultured cells were collected by centrifugation for 1 min at 13,000 rpm, total lipids were extracted, and fatty acid methyl esters ["FAMEs"] were prepared by trans-esterification, and subsequently analyzed with a Hewlett-Packard 6890 GC (General Methods).

Based on the fatty acid composition of the 3 mL cultures, selected transformants were further characterized. Specifically, clones #5 and #11 of strain Y8406U transformed with expression vector pY201 (comprising ScAle1S) were selected and designated as "Y8406U::ScAle1S-5" and "Y8406U::ScAle1S-11", respectively; clone #16 of strain Y8406U transformed with expression vector pY168 (comprising YlAle1) was selected and designated as "Y8406U:: YlAle1"; clone #8 of strain Y8406U transformed with expression vector pY208 (comprising MaLPAAT1 S) was selected and designated as "Y8406U::MaLPAAT1S"; clone #21 of strain Y8406U transformed with expression vector pY207 (comprising YlLPAAT1) was selected and designated as "Y8406U::YlLPAAT1"; and clone #23 of strain Y8406U transformed with expression vector pY175 (comprising CeLPCATS) was selected and designated as "Y8406U:: CeLPCATS". Additionally, strain Y8406 (a Ura+ strain that was parent to strain Y8406U (Ura–)) was used as a control.

Each selected transformant and the control was streaked onto MM agar plates. Then, one loop of freshly streaked cells was inoculated into 3 mL FM medium and grown overnight at 250 rpm and 30° C. The $OD_{600nm}$ was measured and an aliquot of the cells were added to a final $OD_{600nm}$ of 0.3 in 25 mL FM medium in a 125 mL flask. After 2 days in a shaker incubator at 250 rpm and at 30° C., 6 mL of the culture was harvested by centrifugation and resuspended in 25 mL HGM in a 125 mL flask. After 5 days in a shaker incubator at 250 rpm and at 30° C., a 1 mL aliquot was used for GC analysis (supra) and 10 mL dried for dry cell weight ["DCW"] determination.

For DCW determination, 10 mL culture was harvested by centrifugation for 5 min at 4000 rpm in a Beckman GH-3.8 rotor in a Beckman GS-6R centrifuge. The pellet was resuspended in 25 mL of water and re-harvested as above. The washed pellet was re-suspended in 20 mL of water and transferred to a pre-weighed aluminum pan. The cell suspension was dried overnight in a vacuum oven at 80° C. The weight of the cells was determined.

Lipid Content, Fatty Acid Composition and Conversion Efficiencies

A total of four separate experiments were conducted under identical conditions. Experiment 1 compared control strain Y8406 versus strain Y8406U::ScAle1S-5. Experiment 2 compared control strain Y8406 versus strain Y8406U::

YlAle1. Experiment 3 compared control strain Y8406 versus strain Y8406U::YlAle1, strain Y8406U::ScAle1S-11, and strain Y8406U::MaLPAAT1S. Experiment 4 compared control strain Y8406 versus strain Y8406U::MaLPAAT1S, strain Y8406U::YlLPAAT1 and strain Y8406U::CeLPCATS.

In each experiment, the lipid content, fatty acid composition and EPA as a percent of the DCW are quantified for 1, 2 or 3 replicate cultures ["Replicates"] of the control Y8406 strain and the transformant Y8406U strain(s). Additionally, data for each Y8406U transformant is presented as a % of the Y8406 control. Table 26 below summarizes the total lipid content of cells ["TFAs % DCW"], the concentration of each fatty acid as a weight percent of TFAs ["% TFAs"] and the EPA content as a percent of the dry cell weight ["EPA % DCW"]. More specifically, fatty acids are identified as 16:0 (palmitate), 16:1 (palmitoleic acid), 18:0 (stearic acid), 18:1 (oleic acid), 18:2 (LA), ALA, EDA, DGLA, ARA, ETrA, ETA and EPA.

Table 27 summarizes the conversion efficiency of each desaturase and the Δ9 elongase functioning in the PUFA biosynthetic pathway and which are required for EPA production. Specifically, the Δ12 desaturase conversion efficiency ["Δ12 CE"], Δ8 desaturase conversion efficiency ["Δ8 CE"], Δ5 desaturase conversion efficiency ["Δ5 CE"], Δ17 desaturase conversion efficiency ["Δ17 CE"] and Δ9 elongation conversion efficiency ["Δ9e CE"] are provided for each control Y8406 strain and the transformant Y8406U strain(s); data for each Y8406U transformant is presented as a % of the Y8406 control. Conversion efficiency was calculated according to the formula: product(s)/(product(s)+substrate)*100, where product includes both product and product derivatives.

TABLE 26

Lipid Content And Composition In LPCAT Transformant Strains Of *Yarrowia lipolytica* Y8406

| Expt. | Strain | Replicates | TFA % DCW | 16:0 | 16:1 | 18:0 | 18:1 | 18:2 | ALA | EDA | DGLA | ARA | ERA | ETA | EPA | EPA % DCW |
|---|---|---|---|---|---|---|---|---|---|---|---|---|---|---|---|---|
| 1 | Y8406 | AVG.3 | 17.6 | 3.8 | 0.7 | 3.3 | 6.4 | 22.6 | 2.5 | 2.8 | 2.2 | 0.5 | 1.9 | 2.0 | 48.9 | 8.6 |
|   | Y8406U:: | AVG.3 | 18.3 | 4.2 | 0.7 | 3.5 | 5.7 | 15.1 | 0.6 | 3.3 | 3.7 | 0.8 | 1.8 | 2.3 | 56.9 | 10.4 |
|   | ScAle1S-5 | % Ctrl | 104 | 111 | 100 | 106 | 89 | 67 | 24 | 118 | 168 | 160 | 95 | 115 | 116 | 121 |
| 2 | Y8406 | AVG.3 | 23.2 | 3.5 | 0.6 | 3.3 | 6.4 | 22.3 | 2.7 | 2.6 | 2.1 | 0.5 | 1.6 | 2.0 | 49.9 | 11.6 |
|   | Y8406U:: | AVG.3 | 22.3 | 3.8 | 0.7 | 2.9 | 3.9 | 12.7 | 0.4 | 3.0 | 3.8 | 0.8 | 1.6 | 2.4 | 60.9 | 13.6 |
|   | YlAle1 | % Ctrl | 96 | 109 | 117 | 88 | 61 | 57 | 15 | 115 | 181 | 160 | 100 | 120 | 122 | 117 |
| 3 | Y8406 | 1 | 26.1 | 2.7 | 0.7 | 2.8 | 6.5 | 20.5 | 2.5 | 3.2 | 2.3 | 0.7 | 0.8 | 0.0 | 50.8 | 13.3 |
|   | Y8406U:: | AVG.2 | 23.3 | 3.3 | 0.7 | 2.4 | 3.6 | 12.1 | 0.5 | 3.2 | 3.5 | 0.9 | 0.0 | 2.3 | 62.2 | 14.5 |
|   | YlAle1 | % Ctrl | 89 | 122 | 100 | 86 | 55 | 59 | 20 | 100 | 152 | 129 | 0 | na | 122 | 109 |
|   | Y8406U:: | AVG.2 | 28.0 | 3.0 | 0.7 | 3.0 | 5.5 | 13.1 | 0.6 | 3.5 | 3.8 | 0.9 | 0.0 | 2.4 | 58.5 | 16.4 |
|   | ScAle1S-11 | % Ctrl | 107 | 111 | 100 | 107 | 85 | 64 | 24 | 109 | 165 | 129 | 0 | na | 115 | 123 |
|   | Y8406U:: | AVG.2 | 23.7 | 4.4 | 0.8 | 4.2 | 6.6 | 11.2 | 0.7 | 2.7 | 3.7 | 0.9 | 0.0 | 2.5 | 57.0 | 13.5 |
|   | MaLPAAT1S | % Ctrl | 91 | 163 | 114 | 150 | 102 | 55 | 28 | 84 | 161 | 129 | 0 | na | 112 | 102 |
| 4 | Y8406 | AVG.2 | 27.9 | 2.8 | 0.6 | 3.1 | 6.2 | 20.6 | 2.9 | 2.9 | 2.0 | 0.6 | 0.7 | 2.0 | 49.4 | 13.8 |
|   | Y8406U:: | AVG.2 | 25.2 | 4.8 | 0.8 | 4.8 | 6.9 | 11.6 | 0.8 | 2.5 | 3.0 | 0.7 | 0.0 | 2.3 | 55.3 | 14.0 |
|   | MaLPAAT1S | % Ctrl | 90 | 171 | 133 | 155 | 111 | 56 | 28 | 86 | 150 | 117 | 0 | 115 | 112 | 101 |
|   | Y8406U:: | AVG.2 | 25.2 | 3.7 | 0.7 | 4.2 | 6.2 | 13.0 | 1.2 | 2.3 | 2.6 | 0.6 | 0.0 | 2.2 | 56.7 | 14.3 |
|   | YlLPAAT1 | % Ctrl | 90 | 132 | 117 | 135 | 100 | 63 | 41 | 79 | 130 | 100 | 0 | 110 | 115 | 104 |
|   | Y8406U:: | AVG.2 | 24.7 | 3.8 | 0.6 | 4.6 | 7.1 | 13.9 | 1.6 | 2.3 | 2.6 | 0.6 | 0.4 | 2.2 | 53.6 | 13.2 |
|   | CeLPCATS | % Ctrl | 89 | 136 | 100 | 148 | 115 | 67 | 55 | 79 | 130 | 100 | 57 | 110 | 109 | 96 |

TABLE 27

Desaturase And Elongase Conversion Efficiency In LPCAT Transformant Strains Of *Yarrowia lipolytica* Y8406

| Expt. | Strain | Replicates | Δ12 CE | Δ9e CE | Δ8 CE | Δ5 CE | Δ17 CE |
|---|---|---|---|---|---|---|---|
| 1 | Y8406 | AVG.3 | 93 | 70 | 92 | 92 | 90 |
|   | Y8406U::ScAle1S-5 | AVG.3 | 94 | 81 | 93 | 91 | 89 |
|   |  | % Ctrl | 101 | 116 | 101 | 98 | 98 |
| 2 | Y8406 | AVG.3 | 93 | 70 | 93 | 93 | 91 |
|   | Y8406U::YlAle1 | AVG.3 | 96 | 85 | 94 | 91 | 90 |
|   |  | % Ctrl | 103 | 121 | 101 | 98 | 98 |
| 3 | Y8406 | 1 | 93 | 72 | 93 | 96 | 89 |
|   | Y8406U::YlAle1 | AVG.2 | 96 | 85 | 96 | 92 | 89 |
|   |  | % Ctrl | 104 | 119 | 103 | 96 | 100 |
|   | Y8406U::ScAle1S-11 | AVG.2 | 94 | 83 | 95 | 91 | 88 |
|   |  | % Ctrl | 101 | 117 | 102 | 95 | 99 |
|   | Y8406U::MaLPAAT1S | AVG.2 | 92 | 85 | 96 | 90 | 89 |
|   |  | % Ctrl | 100 | 119 | 103 | 94 | 100 |
| 4 | Y8406 | AVG.2 | 93 | 71 | 94 | 93 | 91 |
|   | Y8406U::MaLPAAT1S | AVG.2 | 92 | 84 | 96 | 91 | 90 |
|   |  | % Ctrl | 99 | 118 | 102 | 99 | 100 |
|   | Y8406U::YlLPAAT1 | AVG.2 | 93 | 82 | 96 | 92 | 92 |
|   |  | % Ctrl | 100 | 115 | 103 | 100 | 101 |
|   | Y8406U::CeLPCATS | AVG.2 | 92 | 80 | 96 | 92 | 91 |
|   |  | % Ctrl | 99 | 113 | 102 | 99 | 100 |

Based on the data concerning Experiments 1, 2 and 3 in Table 26 and Table 27, overexpression of LPLAT in EPA strains Y8406U::ScAle1S-5, Y8406U::ScAle1S-11, Y8406U::YIAle1 and Y8406U::MaLPAAT1S results in significant reduction (to 67% or below of the control) of the concentration of LA (18:2) as a weight % of TFAs ["LA % TFAs"], an increase (to at least 12% of the control) in the concentration of EPA as a weight % of TFAs ["EPA % TFAs"], and an increase (to at least 16% of the control) in the conversion efficiency of the Δ9 elongase. Compared to Y8406U::ScAle1S-5 and Y8406U::ScAle1S-11, Y8406U::YIAle1 has lower LA % TFAs, higher EPA % TFAs, better Δ9 elongation conversion efficiency, and slightly lower TFAs % DCW and EPA % DCW. Y8406U::YIAle1 and Y8406U::MaLPAAT1S are similar except overexpression of MaLPAAT1S resulted in lower LA % TFAs, EPA % TFAs, and EPA % DCW.

Experiment 4 shows that overexpression of LPLAT in EPA strains Y8406U::YIAle1, Y8406U::MaLPAAT1S and Y8406U::CeLPCATS results in significant reduction (to 67% or below of the control) of LA % TFAs, an increase (to at least 9% of the control) in EPA % TFAs, and an increase (to at least 13% of the control) in the conversion efficiency of the Δ9 elongase. Compared to Y8406U::CeLPCATS, Y8406U::YLPAAT1 and Y8406U::MaLPAAT1S both have lower LA % TFAs, higher EPA % TFAs, higher EPA % DCW, and slightly better TFAs % DCW. Y8406U::YILPAAT1 and Y8406U::MaLPAAT1S are similar except overexpression of MaLPAAT1S results in lower LA % TFAs, slightly lower EPA % TFAs and EPA % DCW, and slightly better Δ9 elongase conversion efficiency.

It is well known in the art that most desaturations occur at the sn-2 position of phospholipids, while fatty acid elongations occur on acyl-CoAs. Furthermore, ScAle1S, YIAle1, MaLPAAT1S and YILPAAT1 were expected to only incorporate acyl groups from the acyl-CoA pool into the sn-2 position of lysophospholipids, such as lysophosphatidic acid ["LPA"] and lysophosphatidylcholine ["LPC"]. Thus, it was expected that expression of ScAle1S, YIAle1, MaLPAAT1S, and YILPAAT1 would result in improved desaturations due to improved substrate availability in phospholipids, and not result in improved elongations that require improved substrate availability in the CoA pool. Our data (supra) shows that unexpectedly, expression of ScAle1S, YIAle1, MaLPAAT1S and YILPAAT1 significantly improved the Δ9 elongase conversion efficiency in strains of Yarrowia producing EPA but did not improve the desaturations (measured as Δ12 desaturase conversion efficiency, Δ8 desaturase conversion efficiency, Δ5 desaturase conversion efficiency or Δ17 desaturase conversion efficiency).

CeLPCAT was previously shown to improve Δ6 elongation conversion efficiency in Saccharomyces cerevisiae fed LA or GLA (Intl App. Pub. No. WO 2004/076617). This was attributed to its reversible LPCAT activity that released fatty acids from phospholipids into the CoA pool. An improvement in Δ9 elongation conversion efficiency in an oleaginous microbe, such as Yarrowia lipolytica, engineered for high level LC-PUFA production in the absence of feeding fatty acids was not contemplated in Intl. App. Pub. No. WO 2004/076617.

Furthermore, expression of ScAle1S, YIAle1, MaLPAAT1S, YILPAAT1 and CeLPCATS did not significantly alter either the level of PUFAs accumulated or the total lipid content in strains of Yarrowia producing EPA.

Previous studies have shown that both Δ6 elongation and Δ9 elongation are bottlenecks in long chain PUFA biosynthesis due to poor transfer of acyl groups between phospholipid and acyl-CoA pools. Based on the improved Δ9 elongase conversion efficiency resulting from over-expression of LPLATs, demonstrated above, it is anticipated that the LPLATs described herein and their orthologs, such as ScLPAAT, will also improve Δ6 elongation conversion efficiency.

Example 10

Construction of Expression Vectors Comprising LPAAT ORFs and an Autonomously Replicating Sequence The present example describes the construction of vectors comprising autonomously replicating sequences ["ARS"] and LPAAT ORFs suitable for LPAAT gene expression without integration in Yarrowia lipolytica. ORFs included the Saccharomyces cerevisiae LPAAT encoding SEQ ID NO:32 and the Yarrowia lipolytica LPAAT1 encoding SEQ ID NO:31. Example 11 describes the results obtained following transformation of these vectors into Y. lipolytica.

Construction of pY222, Comprising a Codon-Optimized Saccharomyces cerevisiae LPAAT Gene The Saccharomyces cerevisiae ORF designated as "ScLPAAT" (SEQ ID NO:32) was optimized for expression in Yarrowia lipolytica, by DNA 2.0 (Menlo Park, Calif.). In addition to codon optimization, 5' Pci1 and 3' Not1 cloning sites were introduced within the synthetic gene (i.e., ScLPAATS; SEQ ID NO:151). None of the modifications in the ScLPAATS gene changed the amino acid sequence of the encoded protein (i.e., the protein sequence encoded by the codon-optimized gene [i.e., SEQ ID NO:152] is identical to that of the wildtype protein sequence [i.e., SEQ ID NO:32]). ScLPAATS was cloned into pJ201 (DNA 2.0) to result in pJ201:ScLPAATS.

Figure 14A:
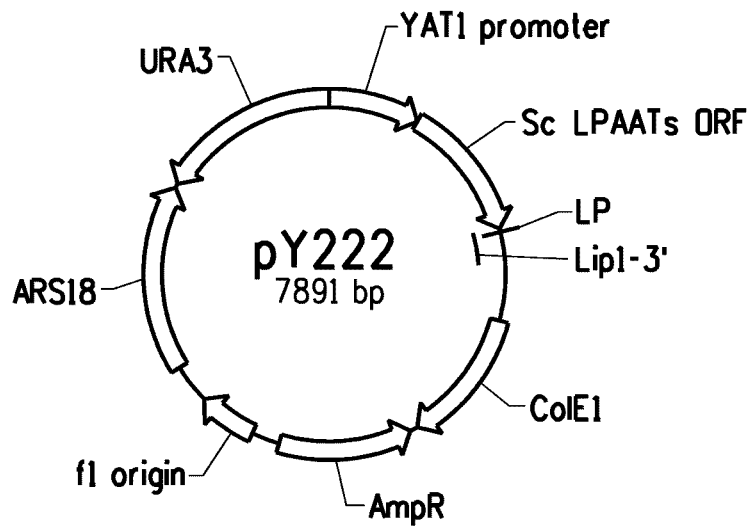

A 926 by Pci1 1Not1 fragment comprising ScLPAATS was excised from pJ201:ScLPAATS and cloned into NcoI-Not1 cut pYAT-DG2-1 to create pY222 (SEQ ID NO:153; Table 28; FIG. 14A). Thus, pY222 contained the following components:

TABLE 28

Description of Plasmid pY222 (SEQ ID NO: 153)

| RE Sites And Nucleotides Within SEQ ID NO: 153 | Description Of Fragment And Chimeric Gene Components |
|---|---|
| Sa/1/SwaI (1-2032) | YAT1::ScLPAATS::Lip1, comprising: YAT1: Yarrowia lipolytica YAT1 promoter (U.S. Pat. Appl. Pub. No. 2006/0094102-A1); ScLPAATS: codon-optimized ScLPAATS (SEQ ID NO: 151) (labeled as "Sc LPAATs ORF" in Figure); Lip1: Lip1 terminator sequence from Yarrowia Lip1 gene |

TABLE 28-continued

Description of Plasmid pY222 (SEQ ID NO: 153)

| RE Sites And Nucleotides Within SEQ ID NO: 153 | Description Of Fragment And Chimeric Gene Components |
|---|---|
| | (GenBank Accession No. Z50020) (labeled as "Lip1-3'" in Figure) |
| SwaI/AvaI (2032-4946) | ColE1 plasmid origin of replication; Ampicillin-resistance gene ($Amp^R$) for selection in *E. coli*; *E. coli* f1 origin of replication |
| AvaI-SphI (4946-6330) | *Yarrowia lipolytica* centromere and autonomously replicating sequence ["ARS"] 18 locus |
| SphI-SaI (6330-1) | *Yarrowia lipolytica* URA3 gene (GenBank Accession No. AJ306421) |

Construction of pY177, Comprising a *Yarrowia lipolytica* LPAAT1 Gene

Figure 14B:
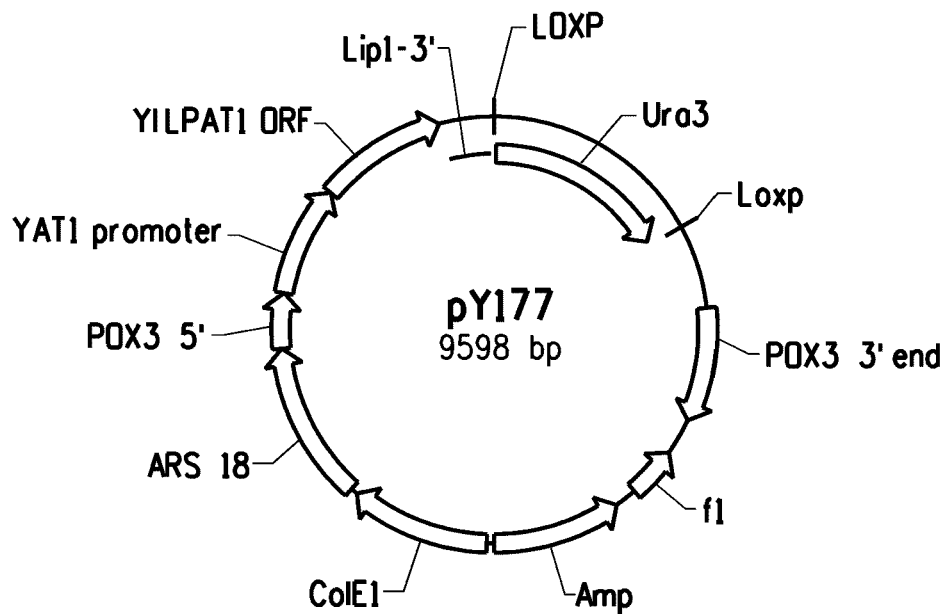

The *Yarrowia lipolytica* centromere and autonomously replicating sequence ["ARS"] was amplified by standard PCR using primer 869 (SEQ ID NO:154) and primer 870 (SEQ ID NO:155), with plasmid pYAT-DG2-1 as template. The PCR product was digested with AscI/AvrII and cloned into AscI-AvrII digested pY207 (SEQ ID NO:149; Example 8) to create pY177 (SEQ ID NO:156; Table 29; FIG. 14B). Thus, the components present in pY177 are identical to those in pY207 (FIG. 12A), except for the replacement of the 373 by pY207 sequence between AscI and AvrII with the 1341 by sequence containing ARS. More specifically, pY177 contained the following components:

the *Saccharomyces cerevisiae* LPAATS (SEQ ID NO:151) and *Yarrowia lipolytica* LPAAT1 (SEQ ID NO:30) without integration on self-replicating plasmids. This was in spite of the host containing its native LPAATs.

Transformation and Growth

*Yarrowia lipolytica* strain Y8406U (Example 9) was individually transformed with uncut plasmids from Example 10. Specifically, vectors pY177 (YAT1::YILPAAT1::Lip1) [SEQ ID NO:156] and pY222 (YAT1::ScLPAATS::Lip1) [SEQ ID NO:153] were transformed according to the General Methods.

Each transformation mix was plated on MM agar plates. Several resultant URA+ transformants were picked and inoculated into 3 mL CSM-U medium (Teknova Cat. No.

TABLE 29

Description of Plasmid pY177 (SEQ ID NO: 156)

| RE Sites And Nucleotides Within SEQ ID NO: 156 | Description Of Fragment And Chimeric Gene Components |
|---|---|
| BsiWI/SbfI (1-1706 bp) | LoxP::Ura3::LoxP, comprising: LoxP sequence (SEQ ID NO: 140) *Yarrowia lipolytica* Ura3 gene (GenBank Accession No. AJ306421); LoxP sequence (SEQ ID NO: 140) |
| SbfI/SphI (1706-3043 bp) | 3' portion of *Yarrowia lipolytica* POX3 Acyl-CoA oxidase 3 (GenBank Accession No. YALI0D24750g) |
| SphI/AscI (3043-5743 bp) | ColE1 plasmid origin of replication; Ampicillin-resistance gene ($Amp^R$) for selection in *E. coli*; *E. coli* f1 origin of replication |
| AscI/BsiWI (5743-6513 bp) | 5' portion of *Yarrowia lipolytica* POX3 Acyl-CoA oxidase 3 (GenBank Accession No. YALI0D24750g) |
| AscI/AvrII (5743-7084 bp) | *Yarrowia lipolytica* centromere and autonomously replicating sequence ["ARS"] 18 locus |
| AvrII/BsiWI (7084-7481 bp) | 5' portion of *Yarrowia lipolytica* POX3 Acyl-CoA oxidase 3 (GenBank Accession No. YALI0D24750g) |
| BsiWI/BsiWI (7481-1 bp) | YAT1::YILPAAT1::Lip1, comprising: YAT1: *Yarrowia lipolytica* YAT1 promoter (U.S. Pat. Appl. Pub. No. 2006/0094102-A1); YILPAAT1: *Yarrowia lipolytica* LPAAT1 ("YALI0E18964g"; GenBank Accession No. XP_504127) (SEQ ID NO: 30) (labeled as "Yl LPAT1 ORF" in Figure); Lip1: Lip1 terminator sequence from *Yarrowia* Lip1 gene (GenBank Accession No. Z50020) (labeled as "Lip1-3'" in Figure) |

Example 11

Functional Characterization of Different LPAATs in EPA-Producing *Yarrowia lipolytica* Strain Y8406

*Yarrowia lipolytica* strain Y8406U, producing EPA, was used to functionally characterize the effects of expression of C8140, Teknova Inc., Hollister, Calif.), wherein CSM-U medium refers to CM Broth with glucose minus uracil containing 0.13% amino acid dropout powder minus uracil, 0.17% yeast nitrogen base, 0.5% $(NH_4)_2SO_4$, and 2.0% glucose. After 2 days growth on a shaker at 200 rpm and 30° C., the cultures were harvested by centrifugation and resuspended in 3 mL HGM medium (Cat. No. 2G2080, Teknova Inc.). After 5 days growth on a shaker, 1 mL aliquots of the cultures were harvested and analyzed by GC, as described in Example 9.

Based on the fatty acid composition of the 3 mL cultures, selected transformants were further characterized by flask assay. Specifically, clones #5 and #6 of strain Y8406U transformed with expression vector pY222 (comprising ScLPAATS) were selected and designated as "Y8406U::ScLPAATS-5" and "Y8406U::ScLPAATS-6", respectively; clone #1 of strain Y8406U transformed with expression vector pY177 (comprising YlLPAAT1) was selected and designated as "Y8406U::YILPAAT1". Additionally, strain Y8406 (a Ura+strain that was parent to strain Y8406U (Ura−)) was used as a control.

Each selected transformant and the control was streaked onto MM agar plates. Then, one loop of freshly streaked cells was inoculated into 3 mL CSM-U medium and grown overnight at 250 rpm and 30° C. The $OD_{600nm}$ was measured and an aliquot of the cells were added to a final $OD_{600nm}$ of 0.3 in 25 mL CSM-U medium in a 125 mL flask. After 2 days in a shaker incubator at 250 rpm and at 30° C., 6 mL of the culture was harvested by centrifugation and resuspended in 25 mL HGM in a 125 mL flask. After 5 days in a shaker incubator at 250 rpm and at 30° C., a 1 mL aliquot was used for GC analysis and 10 mL dried for dry cell weight ["DCW"] determination, as described in Example 9.

Lipid Content, Fatty Acid Composition and Conversion Efficiencies

The lipid content, fatty acid composition and EPA as a percent of the DCW are quantified for 2 replicate cultures ["Replicates"] of the control Y8406 strain and the transformant Y8406U strain(s). Additionally, data for each Y8406U transformant is presented as a % of the Y8406 control. Table 30 below summarizes the total lipid content of cells ["TFAs % DCW"], the concentration of each fatty acid as a weight percent of TFAs ["% TFAs"] and the EPA content as a percent of the dry cell weight ["EPA % DCW"]. More specifically, fatty acids are identified as 16:0 (palmitate), 16:1 (palmitoleic acid), 18:0 (stearic acid), 18:1 (oleic acid), 18:2 (LA), ALA, EDA, DGLA, ARA, ETrA, ETA and EPA.

Table 31 summarizes the conversion efficiency of each desaturase and the Δ9 elongase functioning in the PUFA biosynthetic pathway and which are required for EPA production, in a manner identical to that described in Example 9.

TABLE 31

Desaturase And Elongase Conversion Efficiency In ScLPAATS and YILPAAT1 Transformant Strains Of *Yarrowia lipolytica* Y8406

| Strain | Replicates | Δ12 CE | Δ9e CE | Δ8 CE | Δ5 CE | Δ17 CE |
|---|---|---|---|---|---|---|
| Y8406 | AVG.2 | 95 | 77 | 92 | 90 | 92 |
| Y8406U::YILPAAT1 | AVG.2 | 93 | 82 | 92 | 87 | 90 |
|  | % Ctrl | 98 | 107 | 99 | 97 | 98 |
| Y8406U::ScLPAATS-5 | AVG.2 | 94 | 83 | 93 | 89 | 92 |
|  | % Ctrl | 98 | 108 | 100 | 99 | 100 |
| Y8406U::ScLPAATS-6 | AVG.2 | 94 | 83 | 93 | 89 | 92 |
|  | % Ctrl | 99 | 109 | 101 | 99 | 100 |

Based on the data in Table 30 and Table 31 above, overexpression of both ScLPAATS and YILPAAT1 in EPA strains Y8406U::YILPAAT1, Y8406U::ScLPAATS-5 and Y8406U::ScLPAATS-6 resulted in reduction (to 76% or below of the control) of the concentration of LA (18:2) as a weight % of TFAs ["LA % TFAs"], and an increase (to at least 7% of the control) in the conversion efficiency of the Δ9 elongase. ScLPAATS and YILPAAT1 have a similar effect on lipid profile.

The results obtained above were then compared to those obtained in Example 9, although different means were utilized to characterize the LPLATs. Specifically, in Example 9, linearized DNA carrying the LPLATs were transformed by chromosomal integration, since the vectors lacked ARS sequences. This resulted in stable integrations and the strains were grown in the relatively rich, non-selective FM growth medium during both preculture and 2 days growth prior to being transferred to HGM.

In Example 11, the functional characterization of YIL-PAAT1 and ScLPAATS was done on a replicating plasmid. Thus, *Yarrowia lipolytica* strain Y8406 was transformed with circular DNA carrying each LPAAT and ARS sequence. To maintain these plasmids and assay gene expression without integration, it was necessary to grow the transformants on selective medium (i.e., CSM-U medium) during both preculture and 2 days growth prior to being transferred to HGM.

These differences described above can contribute to differences in lipid profile and content, as illustrated by the expression of YILPAAT1 in Examples 9 and 11. The change over control in LA % TFAs, EPA % TFAs, and Δ9 elongase conversion efficiency were 63%, 115%, and 115%, respectively, upon expression of YILPAAT in Example 9, whereas the change over control in LA % TFAs, EPA % TFAs, and Δ9 elongase conversion efficiency were 76%, 101%, and 107%,

TABLE 30

Lipid Content And Composition In ScLPAATS and YILPAAT1 Transformant Strains Of *Yarrowia lipolytica* Y8406

| Strain | Replicates | TFA % DCW | 16:0 | 16:1 | 18:0 | 18:1 | 18:2 | ALA | EDA | DGLA | ARA | ERA | ETA | EPA | EPA % DCW |
|---|---|---|---|---|---|---|---|---|---|---|---|---|---|---|---|
| Y8406 | AVG.2 | 22.0 | 2 | 0 | 2 | 4 | 19 | 2 | 3 | 4 | 1 | 2 | 3 | 55 | 12 |
| Y8406U:: | AVG.2 | 24.6 | 2 | 1 | 2 | 6 | 14 | 1 | 3 | 5 | 1 | 2 | 3 | 55 | 14 |
| YILPAAT1 | % Ctrl | 112 | 98 | 153 | 102 | 148 | 76 | 50 | 120 | 144 | 101 | 109 | 123 | 101 | 113 |
| Y8406U:: | AVG.2 | 21.6 | 3 | 1 | 3 | 6 | 14 | 1 | 3 | 4 | 1 | 2 | 3 | 57 | 12 |
| ScLPAATS-5 | % Ctrl | 98 | 131 | 137 | 125 | 131 | 74 | 56 | 100 | 117 | 86 | 101 | 108 | 104 | 102 |
| Y8406U:: | AVG.2 | 21.4 | 3 | 1 | 3 | 5 | 14 | 1 | 3 | 4 | 1 | 2 | 3 | 58 | 12 |
| ScLPAATS-6 | % Ctrl | 97 | 125 | 133 | 121 | 124 | 72 | 52 | 97 | 119 | 88 | 102 | 111 | 106 | 103 | respectively, upon expression of YlLPAAT in Example 11. Thus, the improvements in Δ9 elongation and LC-PUFA biosynthesis in Example 11 are minimized when compared to those observed in Example 9. These differences can be attributed to the "position effects" of chromosomal integration and/or different growth conditions.

Since the improvements in LC-PUFA biosynthesis (measured as reduction in LA % TFAs, increase in EPA % TFAs and increase in Δ9 elongase conversion efficiency) are similar for both ScLPAATS and YlLPAAT when transformed in *Yarrowia lipolytica* strain Y8406 on a replicating plasmid, it is anticipated that both LPLAATs will also function similarly when stably integrated into the host chromosome. Thus, ScLPAATS will likely improve the lipid profile in a manner similar to that observed in Example 9, when YlLPAAT1 was stably integrated into the host chromosome.

SEQUENCE LISTING (156 sequences)

SEQ ID NO: 1 - protein, 24 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(24)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(24)
GAGPARPAGLPPATYYDSLAVMGS

SEQ ID NO: 2 - protein, 19 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(19)
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(19)
GPARPAGLPPATYYDSLAV

SEQ ID NO: 3 - protein, 18 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(18)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(18)
PARPAGLPPATYYDSLAV

SEQ ID NO: 4 - protein, 18 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(18)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(18)
PTRPAGPPPATYYDSLAV

SEQ ID NO: 5 - protein, 33 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(33)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(33)
PGGPGKPSEIASLPPPIRPVGNPPAAYYDALAT

SEQ ID NO: 6 - protein, 22 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(22)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(22)
PARPAGLPPATYYDSLAVSGRT

SEQ ID NO: 7 - protein, 36 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(36)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(36)
PGGPGKPSEIASLPPPIRPVGNPPAAYYDALATGRT

SEQ ID NO: 8 - DNA, 2112 bp, Artificial Sequence
  Multizyme: EgD9ES/EgD8M gene fusion
  CDS (1)..(2112): Multizyme: EgD9ES/EgD8M gene fusion
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(2112)
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(2112)
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaa

SEQ ID NO: 9 - protein, 703 aa, Artificial Sequence
  Synthetic Construct
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQGAGPARPAGLPPATYYDSLAVMGSVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 10 - DNA, 2109 bp, Artificial Sequence
  Multizyme: EaD9ES/EaD8S gene fusion
  CDS (1)..(2109): Multizyme: EaD9ES/EaD8S gene fusion
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(2109)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(2109)
atggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggagggcgccggtcccgctcgacctgccggacttcctcccgctacctactacgactctctggccgtcatgggatccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaa

SEQ ID NO: 11 - protein, 702 aa, Artificial Sequence
  Synthetic Construct
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKEGAGPARPAGLPPATYYDSLAVMGSMVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 12 - DNA, 2127 bp, Artificial Sequence
  Multizyme: E389D9eS/EgD8M gene fusion
  CDS (1)..(2127): Multizyme: E389D9eS/EgD8M gene fusion
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(2127)
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(2127)
atggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaa

SEQ ID NO: 13 - protein, 708 aa, Artificial Sequence
  Synthetic Construct
MAAVIEVANEFVAITAETLPKVDYQRLWRDIYSCELLYFSIAFVILKFTLGELSDSGKKILRVLFKWYNLFMSVFSLVSFLCMGYAIYTVGLYSNECDRAFDNSLFRFATKVFYYSKFLEYIDSFYLPLMAKPLSFLQFFHHLGAPMDMWLFVQYSGESIWIFVFLNGFIHFVMYGYYWTRLMKFNFPMPKQLITAMQITQFNVGFYLVWWYKDIPCYRKDPMRMLAWIFNYWYVGTVLLLFINFFVKSYVFPKPKTADKKVQGAGPARPAGLPPATYYDSLAVMGSVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 14 - DNA, 1860 bp, Saccharomyces cerevisiae
  CDS (1)..(1860): GenBank Accession No. NP_014818; "YOR175C"
  ref <302>: TITLE: Genes encoding a novel type of lysophophatidylcholine acyltransferases and their use to increase triacylglycerol production and/or modify fatty acid composition
  ref <310>: PATENT DOCUMENT NUMBER: US-2008-0145867-A1
  ref <311>: PATENT FILING DATE: 2007-06-15
  ref <312>: PUBLICATION DATE: 2008-06-19
  ref <313>: RELEVANT RESIDUES IN SEQ ID NO: (1)..(1860)
  ref <302>: TITLE: Genes encoding a novel type of lysophophatidylcholine acyltransferases and their use to increase triacylglycerol production and/or modify fatty acid composition
  ref <310>: PATENT DOCUMENT NUMBER: WO 2008/076377
  ref <311>: PATENT FILING DATE: 2007-12-13
  ref <312>: PUBLICATION DATE: 2008-06-26
  ref <313>: RELEVANT RESIDUES IN SEQ ID NO: (1)..(1860)
  ref <302>: TITLE: USE OF A CLASS OF GENES ENCODING LYSOPHOSPHOLIPID ACYL TRANSFERASES FOR APPLICATION IN AGRICULTURE, BIOTECHNOLOGY AND MEDICINE
  ref <310>: PATENT DOCUMENT NUMBER: WO 2009/001315
  ref <311>: PATENT FILING DATE: 2008-06-25
  ref <312>: PUBLICATION DATE: 2008-12-31
  ref <313>: RELEVANT RESIDUES IN SEQ ID NO: (1)..(1860)
atgtacaatcctgtggacgctgttttaacaaagataattaccaactatgggattgatagttttacactgcgatatgctatctgcttattgggatcgttcccactgaatgctattttgaagagaattcccgagaagcgtataggtttaaaatgttgttttatcatttctatgtcgatgttttacttattcggtgtgctgaatctagtaagtggattcaggaccctgtttattagtaccatgtttacttacttgatctcaagattttaccgttccaagtttatgccacacttgaatttcatgtttgttatgggtcatttggcaataaatcatatacacgcccaattccttaacgaacagactcaaactaccgttgacattacaagttcacaaatggttttagccatgaaactaacttcttttgcatggtcgtactatgatggttcatgcactagcgaaagcgatttcaaagatttgactgagcatcaaaaatctcgtgctgtcagaggtcatccacccttattaaagttcctggcatatgcatttttctattcaacgttgctaactggcccaagtttcgattatgccgattttgacagctggttgaattgtgagatgttccgtgacttgcctgaaagcaaaaagcctatgagaagacaccaccctggtgaaagaagacagattccaaagaatggtaaacttgcattatggaaagttgttcaaggtcttgcttggatgattttaagtacactaggaatgaagcacttccccgtaaaatacgttttggacaaagatggcttcccaacgagatcttttatattcagaatccattacttattcttgcttggtttcatccatagattcaagtactacgctgcctggactatttcggaaggatcttgtattttgtgcggtttgggttataatggttatgattcaaagacacaaaagatcagatgggatcgtgtcagaaatattgacatttggaccgtagaaacggcgcagaatacgcgtgaaatgttggaagcatggaatatgaatactaacaagtggctaaaatactctgtttatttacgtgtcacaaagaagggcaaaaaacctggtttccgctcaactttgtttactttcctaacttccgcattttggcatggtaccagacctgggtactatctgacttttgcgacaggggctttgtaccaaacatgtggtaaaatctacagacgcaattttagaccaattttcttgcgagaagatggtgtcactcctttgccttctaaaaaaatctacgatttagttggcatatatgcaattaaactagcatttggttacatggtgcaaccatttattatccttgatttgaagccatctttaatggtatggggctctgtttatttctatgttcatattattgttgctttctcatttttcctattcagaggaccatatgctaaacaagttactgaattttttaaatccaaacaacctaaagaaatattcattagaaaacaaaagaagttggaaaaagatatttctgcaagctctccaaacttgggtggtatattgaaggcaaagattgaacatgaaaagggaaagacagcagaagaagaagaaatgaacttaggtattccaccaattgagttagaaaagtgggacaatgctaaggaagattgggaagatttctgcaaagattacaaagaatggagaaataaaaatggtcttgaaatagaagaggaaaacctttctaaagcttttgaaagattcaagcaggaattttctaacgctgcaagtggatcaggtgaacgtgtgagaaaaatgagttttagtggttactcaccaaagcctatttcaaaaaaggaagagtag

SEQ ID NO: 15 - protein, 619 aa, Saccharomyces cerevisiae
MYNPVDAVLTKIITNYGIDSFTLRYAICLLGSFPLNAILKRIPEKRIGLKCCFIISMSMFYLFGVLNLVSGFRTLFISTMFTYLISRFYRSKFMPHLNFMFVMGHLAINHIHAQFLNEQTQTTVDITSSQMVLAMKLTSFAWSYYDGSCTSESDFKDLTEHQKSRAVRGHPPLLKFLAYAFFYSTLLTGPSFDYADFDSWLNCEMFRDLPESKKPMRRHHPGERRQIPKNGKLALWKVVQGLAWMILSTLGMKHFPVKYVLDKDGFPTRSFIFRIHYLFLLGFIHRFKYYAAWTISEGSCILCGLGYNGYDSKTQKIRWDRVRNIDIWTVETAQNTREMLEAWNMNTNKWLKYSVYLRVTKKGKKPGFRSTLFTFLTSAFWHGTRPGYYLTFATGALYQTCGKIYRRNFRPIFLREDGVTPLPSKKIYDLVGIYAIKLAFGYMVQPFIILDLKPSLMVWGSVYFYVHIIVAFSFFLFRGPYAKQVTEFFKSKQPKEIFIRKQKKLEKDISASSPNLGGILKAKIEHEKGKTAEEEEMNLGIPPIELEKWDNAKEDWEDFCKDYKEWRNKNGLEIEEENLSKAFERFKQEFSNAASGSGERVRKMSFSGYSPKPISKKEE

SEQ ID NO: 16 - DNA, 1539 bp, Yarrowia lipolytica
  CDS (1)..(1539): GenBank Accession No. XP_505624; "YALI0F19514p"
atggcctttccatgggcagataagtgggcagccgatgcgtctgcatctacagggctgcctccggacctcctcaagattgcattcactctggtcatgtcttatccgctgagttctctcatgaaacggctgccagatgacgccaaaaacctcaagatcatctatatcatctccgtgtccatcttctacatggtgggtgtcttctccctctatggcggagctgccactctgctcttctcctcaatgggtaccttcttcatcacccaatggaagagcccttacatgccctgggtcaattttggttttgtcatgacccatctcttcgtcaatcacctgcgttcgcagtttttccccgaaacatacgaccccaatgtcattgacatcaccggagcacagatggttctgtgtatgaagctatcgtcttttggatggaacgtctacgatggatggcagattgagaagggtgagcagctcagcgagttccagactaaaagggctgttctcaagcaccccagtcttatggacttcctagcttttgtgttctacttcccttccattctgacaggtccttcttacgactatatggagttccataactggctcgatctcagcctgttcaaggagctggagaaagataaggaccccaagcgagctgctcgacgaaagcgacacaagatcccccgatctggaatcgctgcttccaagaaactcgccgctggtatcttctggatcgttctgtggacccaggtggactctcgaatctccaccgcctacgcttactcagacgcattcaccaaggagcacaacatctttggacgaattgtgtacctctacatgctcggtttcatgtaccgactcaagtactacggagcctggtccatttccgagggagcctgcatcttgtctggcctcggattccatggcgtggaccccaaaactggcaagtacaagtgggaccgtgtccagaacgtggacccgtggggattcgaaactggtcaaaacacaaaggctctgctggaggcctggaaccagaacactaacaagtggctacgaaactatgtgtacctccgagtggtgcccaaaggccaaaagcctggattccgagccactatcttcacatttgtggtttccgccttctggcatggaactcgacctggctactatctcacctttgtgaccgctgccatgtaccagtctgttggtaagttcttccgacgatacctgcgacccttcttcatggagtctgatggaaagactgccggtccctataagatctactacgacattgtgtgttggatcgttgtccaaaccgcatttggatacgctacccagtcctttatgattctagacttctggctgtcgctcaagtgttggaagaactcctggttcctgtaccacattgctctgggcgccatctttgcaatttctagcccctacaaggcatgggcgattcccaagatcaagaaaaagcaggctggagccgtcactgacaagaaggacgccaaggaggaggtgaagaaggacaccatcaagaccaagtaa

SEQ ID NO: 17 - protein, 512 aa, Yarrowia lipolytica
MAFPWADKWAADASASTGLPPDLLKIAFTLVMSYPLSSLMKRLPDDAKNLKIIYIISVSIFYMVGVFSLYGGAATLLFSSMGTFFITQWKSPYMPWVNFGFVMTHLFVNHLRSQFFPETYDPNVIDITGAQMVLCMKLSSFGWNVYDGWQIEKGEQLSEFQTKRAVLKHPSLMDFLAFVFYFPSILTGPSYDYMEFHNWLDLSLFKELEKDKDPKRAARRKRHKIPRSGIAASKKLAAGIFWIVLWTQVDSRISTAYAYSDAFTKEHNIFGRIVYLYMLGFMYRLKYYGAWSISEGACILSGLGFHGVDPKTGKYKWDRVQNVDPWGFETGQNTKALLEAWNQNTNKWLRNYVYLRVVPKGQKPGFRATIFTFVVSAFWHGTRPGYYLTFVTAAMYQSVGKFFRRYLRPFFMESDGKTAGPYKIYYDIVCWIVVQTAFGYATQSFMILDFWLSLKCWKNSWFLYHIALGAIFAISSPYKAWAIPKIKKKQAGAVTDKKDAKEEVKKDTIKTK

SEQ ID NO: 18 - protein, 7 aa, Artificial Sequence
  membrane bound O-acyltransferase motif
  MISC_FEATURE (2)..(2): Xaa = Val [V] or Ile [I]
  misc_feature (4)..(5): Xaa can be any naturally occurring amino acid
MXLXXKL

SEQ ID NO: 19 - protein, 8 aa, Artificial Sequence
  membrane bound O-acyltransferase motif
  misc_feature (2)..(2): Xaa can be any naturally occurring amino acid
  misc_feature (6)..(7): Xaa can be any naturally occurring amino acid
RXKYYXXW

SEQ ID NO: 20 - protein, 6 aa, Artificial Sequence
  membrane bound O-acyltransferase motif
  misc_feature (3)..(3): Xaa can be any naturally occurring amino acid
SAXWHG

SEQ ID NO: 21 - protein, 20 aa, Artificial Sequence
  motif
  misc_feature (2)..(12): Xaa can be any naturally occurring amino acid
  misc_feature (15)..(16): Xaa can be any naturally occurring amino acid
  MISC_FEATURE (17)..(17): Xaa = Thr [T] or Val [V]
  misc_feature (18)..(19): Xaa can be any naturally occurring amino acid
  ref <302>: TITLE: GENES ENCODING A NOVEL TYPE OF LYSOPHOPHATIDYLCHOLINE ACYLTRANSFERASES AND THEIR USE TO INCREASE TRIACYLGLYCEROL PRODUCTION AND/OR MODIFY FATTY ACID COMPOSITION
  ref <310>: PATENT DOCUMENT NUMBER: U.S. Patent Publication No. 2008-0145867-A1
  ref <311>: PATENT FILING DATE: 2007-06-15
  ref <312>: PUBLICATION DATE: 2008-06-19
  ref <313>: RELEVANT RESIDUES IN SEQ ID NO: (1)..(15)
EXXXXXXXXXXXWNXXXXXW

SEQ ID NO: 22 - DNA, 1870 bp, Saccharomyces cerevisiae
  CDS (3)..(1862): synthetic Ale1 (codon-optimized for Yarrowia lipolytica)
acatgtacaaccccgtggacgcagtgttgactaagattattacaaactacggaattgattcttttaccctgcgatatgccatttgtctgttgggatcttttcctcttaacgctattctgaagcggattcctgaaaagcgaatcggcctgaagtgttgttttatcatttctatgtccatgttttatctcttcggcgttctgaatctcgtgagcggatttcgaaccctcttcatttccacaatgttcacataccttatctctcggttctaccgatccaagtttatgccccatctcaacttcatgttcgtcatgggccacttggctatcaaccacattcatgctcagttcctgaacgaacaaactcaaacgaccgtcgatattacatcctcgcagatggtcctggctatgaagctgacaagctttgcctggtcttactatgacggttcgtgtacgagcgagtccgacttcaaggaccttaccgaacaccagaagtcccgagccgtccgaggccatcctccccttctgaaatttttggcttacgcctttttctactctacccttctcaccggtccctccttcgattacgctgatttcgactcttggctgaactgcgaaatgttccgggaccttcccgagtccaagaaacccatgcgaagacatcatcctggtgagcggcgtcagattcccaagaacggcaagctcgccctgtggaaggttgtccagggcctcgcctggatgattctgagcacgttgggtatgaagcacttccccgtgaagtacgtgctggacaaggacggatttcctacccgttcctttatcttccgtattcattatctgtttctgctgggattcatccaccgatttaagtattacgctgcgtggacgattagcgaaggttcgtgcattctctgtggtcttggttataatggatacgattctaagacccagaagatccggtgggatcgagtgcggaatattgatatttggacagtggagactgcacaaaacacccgagagatgctggaagcgtggaacatgaatactaacaaatggctgaagtatagcgtgtatcttagagtgactaagaagggtaagaagccaggttttcgatctaccctgtttaccttcctgacctccgccttttggcacggtacccgtcctggatactaccttaccttcgcaactggtgccctgtaccaaacctgtggaaagatctatagacgaaactttcgtcccatctttctgagagaagatggcgtgacacctctcccgtccaagaagatttacgacctggtcggcatttacgctattaagctggcctttggttacatggttcaacccttcattatccttgacctgaagccctctcttatggtttggggatccgtgtatttctacgtgcatattattgtggccttctcgttctttctgttccgaggaccatacgctaagcaggttactgaatttttcaaaagcaagcaaccgaaggagatcttcatccgaaagcagaagaagttggaaaaagacatctctgcctcttcccccaacctcggaggtattcttaaggcaaaaatcgaacatgagaagggaaagacggcagaggaggaagagatgaacttgggcattccacccatcgaactggagaagtgggacaacgccaaggaggactgggaggatttctgcaaggactacaaggagtggcggaacaagaacggactggaaattgaagaggagaacctgtccaaggccttcgagcgatttaagcaggaattttccaacgctgcgtcgggctctggtgaacgggttcggaaaatgtccttctccggatattctcctaaacccatctcgaagaaagaagaataggcggccgc

SEQ ID NO: 23 - protein, 619 aa, Saccharomyces cerevisiae; identical to SEQ ID NO: 15

SEQ ID NO: 24 - DNA, 849 bp, Caenorhabditis elegans
  CDS (1)..(849): GenBank Accession No. CAA98276; "clone T06E8.1"
  ref <302>: TITLE: METHOD FOR THE PRODUCTION OF POLYUNSATURATED FATTY ACIDS
  ref <310>: PATENT DOCUMENT NUMBER: US 2006-0168687-A1
  ref <311>: PATENT FILING DATE: 2004-01-29
  ref <312>: PUBLICATION DATE: 2006-07-27
  ref <313>: RELEVANT RESIDUES IN SEQ ID NO: (1)..(849)
  ref <302>: TITLE: METHOD FOR THE PRODUCTION OF POLYUNSATURATED FATTY ACIDS
  ref <310>: PATENT DOCUMENT NUMBER: WO 2004/076617
  ref <311>: PATENT FILING DATE: 2004-01-29
  ref <312>: PUBLICATION DATE: 2004-09-10
  ref <313>: RELEVANT RESIDUES IN SEQ ID NO: (1)..(849)
atggagaacttctggtcgatcgtcgtgttttttctactctcaattctcttcattttatataacatatcgacagtatgccactactatatgcggatttcgttttattacttcacaattttattgcatggaatggaagtttgtgttacaatgatcccttcttggctaaatgggaagggtgctgattacgtgtttcactcgtttttctattggtgtaaatggactggtgttcatacaacagtctatggatatgaaaaaacacaagttgaaggtccggctgtagttatttgtaatcatcagagttctctcgacattctatcgatggcatcaatctggccgaagaattgtgttgtaatgatgaaacgaattcttgcctatgttccattcttcaatctcggagcctacttttccaacacaatcttcatcgatcgatataaccgtgaacgtgcgatggcttcagttgattattgtgcatctgaaatgaagaacagaaatcttaaactttgggtatttccggaaggaacaagaaatcgtgaaggagggttcattccattcaagaaaggagcattcaatattgcagttcgtgcgcagattcccattattccagttgtattctcagactatcgggatttctactcaaagccaggccgatatttcaagaatgatggagaagttgttattcgagttctggatgcgattccaacaaaagggctcactcttgatgacgtcagcgagttgtctgatatgtgtcgggacgttatgttggcagcctataaggaagttactctagaagctcagcaacgaaatgcgacacggcgtggagaaacaaaagacgggaagaaatctgagtaa

SEQ ID NO: 25 - protein, 282 aa, Caenorhabditis elegans
MENFWSIVVFFLLSILFILYNISTVCHYYMRISFYYFTILLHGMEVCVTMIPSWLNGKGADYVFHSFFYWCKWTGVHTTVYGYEKTQVEGPAVVICNHQSSLDILSMASIWPKNCVVMMKRILAYVPFFNLGAYFSNTIFIDRYNRERAMASVDYCASEMKNRNLKLWVFPEGTRNREGGFIPFKKGAFNIAVRAQIPIIPVVFSDYRDFYSKPGRYFKNDGEVVIRVLDAIPTKGLTLDDVSELSDMCRDVMLAAYKEVTLEAQQRNATRRGETKDGKKSE

SEQ ID NO: 26 - DNA, 859 bp, Caenorhabditis elegans
  CDS (3)..(851): synthetic LPCAT (codon-optimized for Yarrowia lipolytica)
ccatggagaacttctggtccatcgtcgtgttctttctgctctccattctgttcatcctctacaacatttcgacagtctgccactactacatgcgaatctccttctactactttaccatcctgcttcacggcatggaggtgtgcgttaccatgattccctcttggctcaacggcaagggtgccgactacgtgtttcactcgttcttctactggtgcaagtggactggagtccacaccactgtgtatggctacgagaagacccaggtcgaaggtcctgccgtggtcatctgcaaccatcagtcctcgctcgacattctgtctatggcttccatctggcccaagaactgtgttgtcatgatgaagcggattcttgcctacgttcccttcttcaacctgggagcctacttttccaacaccatcttcatcgaccgatacaaccgagagcgagctatggcttctgtcgactactgtgcctccgagatgaagaaccgaaacctgaagctctgggtgtttcccgaaggcactcggaatcgagagggtggattcattcccttcaagaaaggtgccttcaacatcgctgttcgagcccagattcccatcattcctgtcgtgttctctgactatcgagacttctactccaagcctggccgatacttcaagaacgatggagaggtcgtgatccgagtcctggatgccattcccaccaagggtctgaccctcgatgacgtctctgagctttcggacatgtgtcgagacgtcatgctggctgcctacaaggaagttaccctcgaggctcagcaacgaaacgccactcgaagaggagagaccaaggacggcaagaaatccgagtaagcggccgc

SEQ ID NO: 27 - protein, 282 aa, Caenorhabditis elegans; identical to SEQ ID NO: 25

SEQ ID NO: 28 - DNA, 945 bp, Mortierella alpina
  CDS (1)..(945): LPAAT1
  ref <302>: TITLE: High eicosapentaenoic acid producing strains of Yarrowia lipolytica
  ref <310>: PATENT DOCUMENT NUMBER: US-2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(945)
  ref <302>: TITLE: High eicosapentaenoic acid producing strains of Yarrowia lipolytica
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(945)
atgtccataggttcttccaatcctgtcctgctggcagcgatccccttcgtctacctcttcgtcctccctcgtgtcctcgccttcctccctcaaaaggcccagttcctcgcaaaatgcatcgtggtcttgatcgccacccttatcatgtccgtcgcaggctgcttcatttccatcgtctgtgcgctcctcgataaacgctatgtgatcaactacgtcgtctcaagactcttctcattcctcgctgcaagaccctgcggtgtcacctacaagatcgtcggcgaggaacatctggacaagtaccccgccattgtcgtctgcaaccaccagagctccatggacatgatggtcctgggacgcgtcttcccaaagcactgtgtcgtcatggcaaagaaggaacttctttactttccgttcctgggcatgtttatgaagctgagtaacgccatcttcattgaccgcaagaaccacaagaaggcgatcgagtccaccacccaagctgtcgccgacatgaagaagcacaactctggaatctggattttccccgaaggaacacgttcccgcttggacaaggccgatctcttgcccttcaagaagggagccttccacctcgccattcaagcccaactcccgatcctccccatcatctcgcaaggatactcacacatctacgattcgtcaaaacgctacttccccggtggagagctcgagatcagagtcctggaacctatccccaccacgggattgaccacagacgatgtgaacgacctgatggacaagactcgcaacctgatgctgaagcacctcaaggagatggattctcaatactcctcctccaccgctgaaaacggatcgacccatattgacgccgatatcgcaaagtcaactgccacatcgatcggaaacacggacgatgctatcacaaagaggaggacaccaaaagagtag

SEQ ID NO: 29 - protein, 314 aa, Mortierella alpina
MSIGSSNPVLLAAIPFVYLFVLPRVLAFLPQKAQFLAKCIVVLIATLIMSVAGCFISIVCALLDKRYVINYVVSRLFSFLAARPCGVTYKIVGEEHLDKYPAIVVCNHQSSMDMMVLGRVFPKHCVVMAKKELLYFPFLGMFMKLSNAIFIDRKNHKKAIESTTQAVADMKKHNSGIWIFPEGTRSRLDKADLLPFKKGAFHLAIQAQLPILPIISQGYSHIYDSSKRYFPGGELEIRVLEPIPTTGLTTDDVNDLMDKTRNLMLKHLKEMDSQYSSSTAENGSTHIDADIAKSTATSIGNTDDAITKRRTPKE

SEQ ID NO: 30 - DNA, 1549 bp, Yarrowia lipolytica
  CDS (501)..(1349): LPAAT1
  ref <302>: TITLE: High eicosapentaenoic acid producing strains of Yarrowia lipolytica
  ref <310>: PATENT DOCUMENT NUMBER: US-2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(1549)
  ref <302>: TITLE: High eicosapentaenoic acid producing strains of Yarrowia lipolytica
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(1549)
cacagcataataccacggcatgaccccgctgactccaaccttcatttcggcacatgtaggtgcacaagggacttcaagaggggccaatttcatgcggacacatggcgcaaaaaacgcccgactttgattacacagacacgtaataacgacgaagccgagatgagcacacgtggccaagtctgccaatggccccctggacccccctgacaaagtttcccaacaagcccagccgtgcatggtgtgtttttgtgcggagacacacgccaattaggctcatttgagggtatgcagcgaaaaaaaattagtgtgggtagtttgtttgcaggaatcaagtgggtggttgaaaaacaagaaagagcgacgacaagagagagagaaaaagagagagagactccataaagcgtgcatcaaaattaaggtgtgtgactatccgaaaaccaaacatgaacagttggatatatgtcgctgtgattgcagttgctgccgttctcattgcccgaatgtccgttgcatccaagctcgtcttctacgtccgcgccgccatcgccgtggtcatctttgccgcctgtgccacctacggcgtgctggcgtccaccattctcaccgccatcggcaagcagggcctggcccaatggaccgttgccagagccttctactactcggtgcgcatcttcctgggtatcagcatcaagctgcgtagccggcaggtgaccggaaccgccggtctggatgcctccaagatccaggtcgccaacaccaccaagcccattgacgacatcaccaaacacctgccccgaccatgcattctgatttccaaccaccagaacgaaatggacattctggtgctcggtcgcatcttcccccagtactgctccgtcaccgccaaaaaggccctcaagtggtaccctctgctgggccagttcatggcgctgtccggcaccatcttcctggaccgaaaggaccgaaccaagtccgtgcagaccctcggcggcgccgtcaagaccatccagagcggcaacggaggcaagggccagagcgtcttcatgttccccgagggaacccgatcctactccaaggacgtcggcatcatgcccttcaagaagggctgtttccacctggcggtccagtcgggcgctcccattgtccccgtggtggtccagaacacctcccgaatgttttctttcggccgaggcaagctggacgccggagagatccttgtcgacgtcctgagccccattgagaccaagggtctggacgccagcaacgtcgacgctctcatggccaccacttataaggccatgtgcgagactgccgaccagattggctacgctggccagaagactcagtagagactgcagcacaagaagtgcttgtagctactttaggagagagataggtaatatgaaacatttttcagatcgacacccacggcgaaccattggctgtggagctatgggtgaatggattaatatagcaacgaaatctacctcgattaccaacgcaaaacgagcccactttctctgtactgtgctatatcgtgtatacccca

SEQ ID NO: 31 - protein, 282 aa, Yarrowia lipolytica
MSVASKLVFYVRAAIAVVIFAACATYGVLASTILTAIGKQGLAQWTVARAFYYSVRIFLGISIKLRSRQVTGTAGLDASKIQVANTTKPIDDITKHLPRPCILISNHQNEMDILVLGRIFPQYCSVTAKKALKWYPLLGQFMALSGTIFLDRKDRTKSVQTLGGAVKTIQSGNGGKGQSVFMFPEGTRSYSKDVGIMPFKKGCFHLAVQSGAPIVPVVVQNTSRMFSFGRGKLDAGEILVDVLSPIETKGLDASNVDALMATTYKAMCETADQIGYAGQKTQ

SEQ ID NO: 32 - protein, 303 aa, Saccharomyces cerevisiae
  MISC_FEATURE (1)..(303): Slc1p; GenBank Accession No.  NP_010231
MSVIGRFLYYLRSVLVVLALAGCGFYGVIASILCTLIGKQHLAQWITARCFYHVMKLMLGLDVKVVGEENLAKKPYIMIANHQSTLDIFMLGRIFPPGCTVTAKKSLKYVPFLGWFMALSGTYFLDRSKRQEAIDTLNKGLENVKKNKRALWVFPEGTRSYTSELTMLPFKKGAFHLAQQGKIPIVPVVVSNTSTLVSPKYGVFNRGCMIVRILKPISTENLTKDKIGEFAEKVRDQMVDTLKEIGYSPAINDTTLPPQAIEYAALQHDKKVNKKIKNEPVPSVSISNDVNTHNEGSSVKKMH

SEQ ID NO: 33 - protein, 7 aa, Artificial Sequence
  1-acyl-sn-glycerol-3-phosphate acyltransferase motif
  misc_feature (3)..(6): Xaa can be any naturally occurring amino acid
NHXXXXD

SEQ ID NO: 34 - protein, 4 aa, Artificial Sequence
  1-acyl-sn-glycerol-3-phosphate acyltransferase motif
EGTR

SEQ ID NO: 35 - DNA, 955 bp, Mortierella alpina
  CDS (3)..(947): synthetic LPAAT1 (codon-optimized for Yarrowia lipolytica)
acatgtctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgc

SEQ ID NO: 36 - protein, 314 aa, Mortierella alpina; identical to SEQ ID NO: 29

SEQ ID NO: 37 - DNA, 1185 bp, Yarrowia lipolytica
  CDS (1)..(1185): diacylglycerol cholinephosphotransferase (YlCPT1)
  ref <302>: TITLE: HIGH EICOSAPENTAENOIC ACID PRODUCING STRAINS OF
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(1185)
  ref <302>: TITLE: HIGH EICOSAPENTAENOIC ACID PRODUCING STRAINS OF
  ref <310>: PATENT DOCUMENT NUMBER: US 2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(1185)
atgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaa

SEQ ID NO: 38 - protein, 394 aa, Yarrowia lipolytica
MGVFIKQEQLPALKKYKYSAEDHSFISNNILRPFWRQFVKIFPLWMAPNMVTLLGFFFVIVNFITMLIVDPTHDREPPRWVYLTYALGLFLYQTFDACDGSHARRTGQSGPLGELFDHCVDAMNTSLILTVVVSTTHMGYNMKLLIVQIAALGNFYLSTWETYHTGTLYLSGFSGPVEGILILVALFVLTFFTGPNVYALTVYEALPESITSLLPASFLDVTITQIYIGFGVLGMVFNIYGACGNVIKYYNNKGKSALPAILGIAPFGIFYVGVFAWAHVAPLLLSKYAIVYLFAIGAAFAMQVGQMILAHLVLAPFPHWNVLLFFPFVGLAVHYIAPVFGWDADIVSVNTLFTCFGATLSIYAFFVLEIIDEITNYLDIWCLRIKYPQEKKTE

SEQ ID NO: 39 - DNA, 1515 bp, Rhizobium leguminosarum bv. viciae 3841
  CDS (1)..(1515): GenBank Accession No. YP_766603
gtgagcaaccatcttttcgacgccatgcgggctgccgcgcccggtgacgcaccgttcatccggatcgataacgcgcgcacatggacctatgatgacgcgatcgctctttccggccgtattgccggcgcgatggacgcgctcggcattcgccccggcgaccgggtggcggtgcaggtcgagaaaagtgccgaggcgttgatcctctatctcgcctgtcttcgaaccggcgccgtctacctgccgctcaacaccgcctatacgctggctgagctcgattactttatcggcgatgcggagccgcgtttggtggtggttgcgccggcggctcgaggcggcgtggagacaatcgccaagcgccacggcgcgatcgtcgaaacgctcgatgctgatggccgcggctcattgctggatctcgcacgcgatgagccggccgactttgtcgatgcctcgcgttccgcggatgatctggccgcgatcctctacacgtcgggaacgaccggacgctccaagggggcgatgctcacgcatgggaacctgctctcgaacgccctgaccttgcgagactattggcgcgtcaccgctgacgatcggctgatccatgccttgccgatcttccacacgcatgggctgttcgtcgccacgaacgtcacactgcttgccggcgcctcgatgttcctgctgtcgaaattcgacgccgacgaggtcgtttcactgatgccacaggcaactatgctgatgggcgtgccgaccttctacgtgcgcctcctgcaaagcccgcgcctcgaaaaaggggcggtcgccagcatccgcctcttcatttccggttcggctcccctgctggccgaaacccatgccgagttccatgcgcgtaccggtcacgccattctcgagcgctacggcatgacggaaaccaatatgaacacgtccaacccctatgagggcaaacggattgccggaacggttggtttcccgctgcctgatgtgacggtgcgcgtcaccgatcccgccaccgggctcgtgctgccacctgaagagacgggcatgatcgagatcaagggaccgaacgtcttcaagggctattggcgcatgccggaaaagaccgcggccgaattcaccgccgacggtttcttcatcagcggcgatctcggcaagatcgaccgggaaggttatgtccacatcgtcggtcgcggcaaggatctggtgatctcgggtggatacaacatctatccgaaagaggtcgaaggcgagatcgaccagatcgagggtgtggttgagagcgctgtgatcggtgtgccgcatcccgatttcggagaaggcgtaacggctgtcgtcgtatgtaagcccggcgccgtcctcgatgaaaagaccatcgtcagcgccctccaggaccgtctcgcccgctacaaacaacccaagcgcatcatcttcgccgacgacctgccgcgcaacactatgggtaaggttcagaagaatatcctgcggcagcaatacgccgatctttataccaggaggtaa

SEQ ID NO: 40 - protein, 504 aa, Rhizobium leguminosarum bv. viciae 3841
VSNHLFDAMRAAAPGDAPFIRIDNARTWTYDDAIALSGRIAGAMDALGIRPGDRVAVQVEKSAEALILYLACLRTGAVYLPLNTAYTLAELDYFIGDAEPRLVVVAPAARGGVETIAKRHGAIVETLDADGRGSLLDLARDEPADFVDASRSADDLAAILYTSGTTGRSKGAMLTHGNLLSNALTLRDYWRVTADDRLIHALPIFHTHGLFVATNVTLLAGASMFLLSKFDADEVVSLMPQATMLMGVPTFYVRLLQSPRLEKGAVASIRLFISGSAPLLAETHAEFHARTGHAILERYGMTETNMNTSNPYEGKRIAGTVGFPLPDVTVRVTDPATGLVLPPEETGMIEIKGPNVFKGYWRMPEKTAAEFTADGFFISGDLGKIDREGYVHIVGRGKDLVISGGYNIYPKEVEGEIDQIEGVVESAVIGVPHPDFGEGVTAVVVCKPGAVLDEKTIVSALQDRLARYKQPKRIIFADDLPRNTMGKVQKNILRQQYADLYTRR

SEQ ID NO: 41 - DNA, 1518 bp, Rhizobium leguminosarum bv. viciae 3841
  CDS (1)..(1518): synthetic malonyl-CoA synthetase (codon-optimized for Yarrowia lipolytica)
atggtctccaaccacctgttcgacgccatgcgagctgccgctcccggagacgcacctttcattcgaatcgacaacgctcggacctggacttacgatgacgccattgctctttccggtcgaatcgctggagctatggacgcactcggcattcgacccggagacagagttgccgtgcaggtcgagaagtctgccgaggcgttgattctctacctggcctgtcttcgaaccggagctgtctacctgcctctcaacactgcctacaccctggccgagctcgactacttcatcggcgatgccgaaccgcgtctggtggtcgttgctcccgcagctcgaggtggcgtggagacaattgccaagcgacacggtgctatcgtcgaaaccctcgacgccgatggacgaggctccttgctggaccttgctagagatgagcctgccgactttgtcgatgcttcgcgatctgccgacgatctggctgctattctctacacttccggtacaaccggacgatcgaagggtgccatgcttactcatggcaatctgctctccaacgctctcaccttgcgagactattggagagttaccgcagacgatcgactcatccatgccttgccaatctttcacactcatggtctgttcgttgctacgaacgtcacactgcttgcaggagcctcgatgtttctgctctccaagttcgatgccgacgaggtcgtttctctcatgccacaggccaccatgcttatgggcgtgcccacattctacgttcgattgctgcagagtcctcgactcgagaagggtgctgtggccagcatcagactgttcatttctggatcagctcccttgcttgccgaaacccacgccgagtttcatgctcgtactggtcacgccattctcgagcgatacggcatgacggaaaccaacatgaatacttccaacccctacgagggcaagcgtattgccggaaccgttggttttcctctgcccgacgtcactgtgcgagtcaccgatcccgccaccggtctcgttcttccacctgaagagactggcatgatcgagatcaagggacccaacgtcttcaagggctattggcgaatgcccgaaaagaccgctgccgagtttaccgcagacggtttctttatctctggagatctcggcaagatcgaccgagaaggttacgttcacattgtgggacgaggcaaggacctggtcatttccggtggctacaacatctatcccaaagaggtcgaaggcgagatcgaccagatcgagggtgtggtcgagtctgctgtcattggtgttcctcatcccgatttcggagaaggtgtcaccgctgttgtcgtgtgcaaacctggtgccgttctcgacgaaaagaccatcgtgtctgctctgcaggaccgtcttgcccgatacaagcaacccaagcggattatctttgccgacgatctgcctcgaaacactatgggaaaggttcagaagaacattcttcgacagcaatacgccgatctctacaccagacgataa

SEQ ID NO: 42 - protein, 505 aa, Rhizobium leguminosarum bv. viciae 3841
MVSNHLFDAMRAAAPGDAPFIRIDNARTWTYDDAIALSGRIAGAMDALGIRPGDRVAVQVEKSAEALILYLACLRTGAVYLPLNTAYTLAELDYFIGDAEPRLVVVAPAARGGVETIAKRHGAIVETLDADGRGSLLDLARDEPADFVDASRSADDLAAILYTSGTTGRSKGAMLTHGNLLSNALTLRDYWRVTADDRLIHALPIFHTHGLFVATNVTLLAGASMFLLSKFDADEVVSLMPQATMLMGVPTFYVRLLQSPRLEKGAVASIRLFISGSAPLLAETHAEFHARTGHAILERYGMTETNMNTSNPYEGKRIAGTVGFPLPDVTVRVTDPATGLVLPPEETGMIEIKGPNVFKGYWRMPEKTAAEFTADGFFISGDLGKIDREGYVHIVGRGKDLVISGGYNIYPKEVEGEIDQIEGVVESAVIGVPHPDFGEGVTAVVVCKPGAVLDEKTIVSALQDRLARYKQPKRIIFADDLPRNTMGKVQKNILRQQYADLYTRR

SEQ ID NO: 43 - DNA, 777 bp, Euglena gracilis
  CDS (1)..(777): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtga

SEQ ID NO: 44 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 45 - DNA, 777 bp, Euglena gracilis
  CDS (1)..(777): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US-2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 46 - protein, 258 aa, Euglena gracilis; identical to SEQ ID NO: 44

SEQ ID NO: 47 - DNA, 792 bp, Eutreptiella sp. CCMP389
  CDS (1)..(792): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(792)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(792)
atggctgcggtgatagaggtcgccaacgagtttgtagccatcacggcagaaacgctccccaaagttgactatcaacgactatggcgagacatttacagttgtgagctactgtatttctccattgccttcgtgatcttgaagtttacgttgggcgagttgagcgacagcggaaaaaagattttgagagtgttgttcaagtggtacaatctcttcatgtccgtgttctccttggtgtctttcctttgcatgggctatgccatttataccgtgggcctatactctaacgaatgcgacagggctttcgacaactcgttgttccgctttgcaacaaaggtgttctactacagtaagtttttggagtacatcgactctttttatcttccgctcatggccaagccgctgtctttcctgcaattcttccatcacttgggagcccccatggacatgtggctctttgtccaatattctggggaatctatttggatctttgtgtttttgaatgggttcattcactttgttatgtacgggtactactggactcggctgatgaagttcaatttcccaatgcccaagcagttgattaccgcgatgcagatcacgcagttcaacgttggtttctacctcgtgtggtggtacaaagatattccctgctaccgaaaggatcccatgcgaatgttggcctggatcttcaattactggtatgttgggactgtcttgctgctgttcattaatttcttcgtcaaatcctatgtgttcccaaagccgaagactgcagataaaaaggtccaatag

SEQ ID NO: 48 - protein, 263 aa, Eutreptiella sp. CCMP389
MAAVIEVANEFVAITAETLPKVDYQRLWRDIYSCELLYFSIAFVILKFTLGELSDSGKKILRVLFKWYNLFMSVFSLVSFLCMGYAIYTVGLYSNECDRAFDNSLFRFATKVFYYSKFLEYIDSFYLPLMAKPLSFLQFFHHLGAPMDMWLFVQYSGESIWIFVFLNGFIHFVMYGYYWTRLMKFNFPMPKQLITAMQITQFNVGFYLVWWYKDIPCYRKDPMRMLAWIFNYWYVGTVLLLFINFFVKSYVFPKPKTADKKVQ

SEQ ID NO: 49 - DNA, 792 bp, Eutreptiella sp. CCMP389
  CDS (1)..(792): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(792)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(792)
atggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagtag

SEQ ID NO: 50 - protein, 263 aa, Eutreptiella sp. CCMP389; identical to SEQ ID NO: 48

SEQ ID NO: 51 - DNA, 774 bp, Euglena anabaena UTEX 373
  CDS (1)..(774): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: U.S. 2008-0254522-A1
  ref <311>: PATENT FILING DATE: 2008-04-15
  ref <312>: PUBLICATION DATE: 2008-10-16
  ref <313>: RELEVANT RESIDUES IN SEQ ID NO: (1)..(774)
  ref <302>: TITLE: DELTA-9 ELONGASES AND THEIR USE IN MAKING POLYUNSATURATED FATTY ACIDS
  ref <310>: PATENT DOCUMENT NUMBER: WO 2008/128241
  ref <311>: PATENT FILING DATE: 2008-04-16
  ref <312>: PUBLICATION DATE: 2008-10-23
  ref <313>: RELEVANT RESIDUES IN SEQ ID NO: (1)..(774)
atggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggag

SEQ ID NO: 52 - protein, 258 aa, Euglena anabaena UTEX 373
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKE

SEQ ID NO: 53 - DNA, 774 bp, Euglena anabaena UTEX 373
  CDS (1)..(774): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: U.S. 2008-0254522-A1
  ref <311>: PATENT FILING DATE: 2008-04-15
  ref <312>: PUBLICATION DATE: 2008-10-16
  ref <313>: RELEVANT RESIDUES IN SEQ ID NO: (1)..(774)
  ref <302>: TITLE: DELTA-9 ELONGASES AND THEIR USE IN MAKING POLYUNSATURATED FATTY ACIDS
  ref <310>: PATENT DOCUMENT NUMBER: WO 2008/128241
  ref <311>: PATENT FILING DATE: 2008-04-16
  ref <312>: PUBLICATION DATE: 2008-10-23
  ref <313>: RELEVANT RESIDUES IN SEQ ID NO: (1)..(774)
atggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggag

SEQ ID NO: 54 - protein, 258 aa, Euglena anabaena UTEX 373; identical to SEQ ID NO: 52

SEQ ID NO: 55 - DNA, 1271 bp, Euglena gracilis
  CDS (4)..(1269): delta-8 desaturase ("Eg5" or "EgD8")
  ref <302>: TITLE: DELTA-8 DESATURASE AND ITS USE IN MAKING POLYUNSATURATED FATTY ACIDS
  ref <310>: PATENT DOCUMENT NUMBER: WO 2006/012325 and WO 2006/012326
  ref <311>: PATENT FILING DATE: 2005-06-24
  ref <312>: PUBLICATION DATE: 2006-02-02
  ref <313>: RELEVANT RESIDUES IN SEQ ID NO: (1)..(1271)
  ref <302>: TITLE: DELTA-8 DESATURASE AND ITS USE IN MAKING POLYUNSATURATED FATTY ACIDS
  ref <310>: PATENT DOCUMENT NUMBER: U.S. 7,256,033
  ref <311>: PATENT FILING DATE: 2005-06-24
  ref <312>: PUBLICATION DATE: 2007-08-14
  ref <313>: RELEVANT RESIDUES IN SEQ ID NO: (1)..(1271)
gaaatgaagtcaaagcgccaagcgcttccccttacaattgatggaacaacatatgatgtgtctgcctgggtcaatttccaccctggtggtgcggaaattatagagaattaccaaggaagggatgccactgatgccttcatggttatgcactctcaagaagccttcgacaagctcaagcgcatgcccaaaatcaatcccagttctgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatggtggaaggacagacacaatgcacatcattcggcaaccaatgttcaagggcacgaccctgatattgacaacctccccctcttagcctggtctgaggatgacgtcacacgggcgtcaccgatttcccgcaagctcattcagttccagcagtactatttcttggtcatctgtatcttgttgcggttcatttggtgtttccagagcgtgttgaccgtgcgcagtttgaaggacagagataaccaattctatcgctctcagtataagaaggaggccattggcctcgccctgcactggaccttgaagaccctgttccacttattctttatgcccagcatcctcacatcgctgttggtgtttttcgtttcggagctggttggcggcttcggcattgcgatcgtggtgttcatgaaccactacccactggagaagatcggggactcagtctgggatggccatggattctcggttggccagatccatgagaccatgaacattcggcgagggattatcacagattggtttttcggaggcttgaattaccagattgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataagg

SEQ ID NO: 56 - protein, 421 aa, Euglena gracilis
MKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 57 - DNA, 1272 bp, Euglena gracilis
  CDS (2)..(1270): synthetic delta-8 desaturase (codon-optimized for Yarrowia lipolytica) ("D8SF" or "EgD8S")
  ref <302>: TITLE: DELTA-8 DESATURASE AND ITS USE IN MAKING POLYUNSATURATED FATTY ACIDS
  ref <310>: PATENT DOCUMENT NUMBER: WO 2006/012325 and WO 2006/012326
  ref <311>: PATENT FILING DATE: 2005-06-24
  ref <312>: PUBLICATION DATE: 2006-02-02
  ref <313>: RELEVANT RESIDUES IN SEQ ID NO: (1)..(1272)
  ref <302>: TITLE: DELTA-8 DESATURASE AND ITS USE IN MAKING POLYUNSATURATED FATTY ACIDS
  ref <310>: PATENT DOCUMENT NUMBER: U.S. 7,256,033
  ref <311>: PATENT FILING DATE: 2005-06-24
  ref <312>: PUBLICATION DATE: 2007-08-14
  ref <313>: RELEVANT RESIDUES IN SEQ ID NO: (1)..(1272)
catggtgaagtccaagcgacaggctctgcccctcaccatcgacggaactacctacgacgtctccgcttgggtgaacttccaccctggtggagctgaaatcattgagaactaccagggacgagatgctactgacgccttcatggttatgcactctcaggaagccttcgacaagctcaagcgaatgcccaagatcaacccctcctccgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgctcctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagc

SEQ ID NO: 58 - protein, 422 aa, Euglena gracilis
MVKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 59 - DNA, 1272 bp, Artificial Sequence
  mutant EgD8S-23 delta-8 desaturase (also "EgD8M")
  CDS (2)..(1270)
  ref <302>: TITLE: MUTANT DELTA-8 DESATURASE GENES ENGINEERED BY TARGETED MUTAGENSIS AND THEIR USE IN MAKING POLYUNSATURATED FATTY ACIDS
  ref <310>: PATENT DOCUMENT NUMBER: WO 2008/073271
  ref <311>: PATENT FILING DATE: 2007-12-05
  ref <312>: PUBLICATION DATE: 2008-06-19
  ref <313>: RELEVANT RESIDUES IN SEQ ID NO: (1)..(1272)
  ref <302>: TITLE: MUTANT DELTA-8 DESATURASE GENES ENGINEERED BY TARGETED MUTAGENSIS AND THEIR USE IN MAKING POLYUNSATURATED FATTY ACIDS
  ref <310>: PATENT DOCUMENT NUMBER: US 2008-0138868-A1
  ref <311>: PATENT FILING DATE: 2006-12-07
  ref <312>: PUBLICATION DATE: 2008-06-12
  ref <313>: RELEVANT RESIDUES IN SEQ ID NO: (1)..(1272)
catggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagc

SEQ ID NO: 60 - protein, 422 aa, Artificial Sequence
  Synthetic Construct
MVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 61 - DNA, 1260 bp, Euglena anabaena UTEX 373
  CDS (1)..(1260): delta-8 desaturase
  ref <302>: TITLE: DELTA-8 DESATURASES AND THEIR USE IN MAKING POLYUNSATURATED FATTY ACIDS
  ref <310>: PATENT DOCUMENT NUMBER: U.S. 2008-0254521-A1
  ref <311>: PATENT FILING DATE: 2008-04-09
  ref <312>: PUBLICATION DATE: 2008-10-16
  ref <313>: RELEVANT RESIDUES IN SEQ ID NO: (1)..(1260)
  ref <302>: TITLE: DELTA-8 DESATURASES AND THEIR USE IN MAKING POLYUNSATURATED FATTY ACIDS
  ref <310>: PATENT DOCUMENT NUMBER: WO 2008/124194
  ref <311>: PATENT FILING DATE: 2008-04-10
  ref <312>: PUBLICATION DATE: 2008-10-16
  ref <313>: RELEVANT RESIDUES IN SEQ ID NO: (1)..(1260)
atggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcg

SEQ ID NO: 62 - protein, 420 aa, Euglena anabaena UTEX 373
MVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 63 - DNA, 1260 bp, Euglena anabaena UTEX 373
  CDS (1)..(1260): synthetic delta-8 desaturase (codon-optimized for Yarrowia lipolytica)
  ref <302>: TITLE: DELTA-8 DESATURASES AND THEIR USE IN MAKING POLYUNSATURATED FATTY ACIDS
  ref <310>: PATENT DOCUMENT NUMBER: U.S. 2008-0254521-A1
  ref <311>: PATENT FILING DATE: 2008-04-09
  ref <312>: PUBLICATION DATE: 2008-10-16
  ref <313>: RELEVANT RESIDUES IN SEQ ID NO: (1)..(1260)
  ref <302>: TITLE: DELTA-8 DESATURASES AND THEIR USE IN MAKING POLYUNSATURATED FATTY ACIDS
  ref <310>: PATENT DOCUMENT NUMBER: WO 2008/124194
  ref <311>: PATENT FILING DATE: 2008-04-10
  ref <312>: PUBLICATION DATE: 2008-10-16
  ref <313>: RELEVANT RESIDUES IN SEQ ID NO: (1)..(1260)
atggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcc

SEQ ID NO: 64 - protein, 420 aa, Euglena anabaena UTEX 373; identical to SEQ ID NO: 62

SEQ ID NO: 65 - DNA, 1350 bp, Euglena gracilis
  CDS (1)..(1350): delta-5 desaturase
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136671
  ref <311>: PATENT FILING DATE: 2007-05-16
  ref <312>: PUBLICATION DATE: 2007-11-29
  ref <313>: RELEVANT RESIDUES IN SEQ ID NO: (1)..(1350)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0292924-A1
  ref <311>: PATENT FILING DATE: 2007-05-15
  ref <312>: PUBLICATION DATE: 2007-12-20
  ref <313>: RELEVANT RESIDUES IN SEQ ID NO: (1)..(1350)
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctga

SEQ ID NO: 66 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 67 - DNA, 1350 bp, Euglena gracilis
  CDS (1)..(1350): synthetic delta-5 desaturase (codon-optimized for Yarrowia lipolytica)
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136671
  ref <311>: PATENT FILING DATE: 2007-05-16
  ref <312>: PUBLICATION DATE: 2007-11-29
  ref <313>: RELEVANT RESIDUES IN SEQ ID NO: (1)..(1350)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0292924-A1
  ref <311>: PATENT FILING DATE: 2007-05-15
  ref <312>: PUBLICATION DATE: 2007-12-20
  ref <313>: RELEVANT RESIDUES IN SEQ ID NO: (1)..(1350)
atggctctctcccttactaccgagcagctgctcgagcgacccgacctggttgccatcgacggcattctctacgatctggaaggtcttgccaaggtccatcccggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 68 - protein, 449 aa, Euglena gracilis; identical to SEQ ID NO: 66

SEQ ID NO: 69 - DNA, 1350 bp, Euglena gracilis
  CDS (1)..(1350): mutant delta-5 desaturase
atggctctcagtcttaccacagaacagctgttagaacgccctgatttggttgcgattgatggcatcctctacgaccttgaagggcttgccaaagttcatccaggatccgatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 70 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 71 - DNA, 1350 bp, Euglena gracilis
  CDS (1)..(1350): synthetic mutant delta-5 desaturase (codon-optimized for Yarrowia lipolytica)
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 72 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 73 - DNA, 1392 bp, Peridinium sp. CCMP626
  CDS (1)..(1392): delta-5 desaturase
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136646
  ref <311>: PATENT FILING DATE: 2007-05-16
  ref <312>: PUBLICATION DATE: 2007-11-29
  ref <313>: RELEVANT RESIDUES IN SEQ ID NO: (1)..(1392)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0271632-A1
  ref <311>: PATENT FILING DATE: 2007-05-15
  ref <312>: PUBLICATION DATE: 2007-11-22
  ref <313>: RELEVANT RESIDUES IN SEQ ID NO: (1)..(1392)
atggctccagatgcggacaagttgagacagcgcaaggcgcaatcgattcaagacacggctgattcgcaagctaccgaactcaagattggcaccctgaagggcttgcaggggacagaaatcgtcattgatggagacatttacgatataaaagactttgatcaccccggtggtgaatccatcatgacttttgggggaaacgatgtcaccgccacgtacaagatgatccacccctaccactctaagcaccatttggagaagatgaagaaagtgggacgagttccggactacacctcggaatacaagtttgatactccctttgagcgtgaaatcaagcaagaggtcttcaagattgtgcgacgaggccgcgagtttggaacacctggatacttcttccgggctttctgctacattggacttttcttttacttgcagtatttgtgggtcacgactcccactacctttgccttggcgatcttctatggtgtttcgcaagctttcattggtttgaacgtacaacatgatgccaaccacggagctgcctccaagaagccttggatcaataacttgctaggattgggggctgactttatcggaggttccaaatggttgtggatgaaccagcactggacgcaccacacatacaccaaccaccatgagaaggatcccgatgccttgggcgctgaaccaatgttgttgttcaatgattatcccttgggtcacccaaagcgtactttgattcaccacttccaggccttctattaccttttcgtcttggccggatactgggtctcttcggtcttcaaccctcaaattttggacttgcaacaccgcggtgctcaagcggttggaatgaaaatggagaacgattacattgccaaaagccgaaagtatgccatcttcttgcgtctcttgtatatttacaccaacattgtcgctccgatccaaaaccaaggcttctcgttgaccgtggtcgcccacattttgaccatgggcgtcgcttccagtttgactttggcgactctttttgccttgtcgcacaattttgaaaacgcggatcgcgatcccacttacgaggcccgcaagggaggagagcctgtttgttggttcaagtcgcaagtcgaaacctcgtcaacttacggaggtttcatctcgggttgcttgacgggcggactcaacttccaagtggaacaccacttgttccctcgtatgagttcggcctggtacccctacattgcccctactgttcgagaggtttgcaaaaagcacggagtcaagtacgcatactatccctgggtctggcaaaacttgatttcaactgtcaagtatctgcatcaaagcggaactggatccaactggaagaatggcgccaacccctactcgggaaaattgtaa

SEQ ID NO: 74 - protein, 463 aa, Peridinium sp. CCMP626
MAPDADKLRQRKAQSIQDTADSQATELKIGTLKGLQGTEIVIDGDIYDIKDFDHPGGESIMTFGGNDVTATYKMIHPYHSKHHLEKMKKVGRVPDYTSEYKFDTPFEREIKQEVFKIVRRGREFGTPGYFFRAFCYIGLFFYLQYLWVTTPTTFALAIFYGVSQAFIGLNVQHDANHGAASKKPWINNLLGLGADFIGGSKWLWMNQHWTHHTYTNHHEKDPDALGAEPMLLFNDYPLGHPKRTLIHHFQAFYYLFVLAGYWVSSVFNPQILDLQHRGAQAVGMKMENDYIAKSRKYAIFLRLLYIYTNIVAPIQNQGFSLTVVAHILTMGVASSLTLATLFALSHNFENADRDPTYEARKGGEPVCWFKSQVETSSTYGGFISGCLTGGLNFQVEHHLFPRMSSAWYPYIAPTVREVCKKHGVKYAYYPWVWQNLISTVKYLHQSGTGSNWKNGANPYSGKL

SEQ ID NO: 75 - DNA, 1392 bp, Peridinium sp. CCMP626
  CDS (1)..(1392): synthetic delta-5 desaturase (codon-optimized for Yarrowia lipolytica)
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136646
  ref <311>: PATENT FILING DATE: 2007-05-16
  ref <312>: PUBLICATION DATE: 2007-11-29
  ref <313>: RELEVANT RESIDUES IN SEQ ID NO: (1)..(1392)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0271632-A1
  ref <311>: PATENT FILING DATE: 2007-05-15
  ref <312>: PUBLICATION DATE: 2007-11-22
  ref <313>: RELEVANT RESIDUES IN SEQ ID NO: (1)..(1392)
atggctcccgacgccgacaagctgcgacagcgaaaggctcagtccatccaggacactgccgattctcaggctaccgagctcaagattggcaccctgaagggtctccaaggcaccgagatcgtcattgatggcgacatctacgacatcaaagacttcgatcaccctggaggcgaatccatcatgacctttggtggcaacgacgttactgccacctacaagatgattcatccctaccactcgaagcatcacctggagaagatgaaaaaggtcggtcgagtgcccgactacacctccgagtacaagttcgatactcccttcgaacgagagatcaaacaggaggtcttcaagattgtgcgaagaggtcgagagtttggaacacctggctacttctttcgagccttctgctacatcggtctcttcttttacctgcagtatctctgggttaccactcctaccactttcgcccttgctatcttctacggtgtgtctcaggccttcattggcctgaacgtccagcacgacgccaaccacggagctgcctccaaaaagccctggatcaacaatttgctcggcctgggtgccgactttatcggaggctccaagtggctctggatgaaccagcactggacccatcacacttacaccaaccatcacgagaaggatcccgacgccctgggtgcagagcctatgctgctcttcaacgactatcccttgggtcaccccaagcgaaccctcattcatcacttccaagccttctactatctgtttgtccttgctggctactgggtgtcttcggtgttcaaccctcagatcctggacctccagcaccgaggtgcccaggctgtcggcatgaagatggagaacgactacattgccaagtctcgaaagtacgctatcttcctgcgactcctgtacatctacaccaacattgtggctcccatccagaaccaaggcttttcgctcaccgtcgttgctcacattcttactatgggtgtcgcctccagcctgaccctcgctactctgttcgccctctcccacaacttcgagaacgcagatcgggatcccacctacgaggctcgaaagggaggcgagcctgtctgttggttcaagtcgcaggtggaaacctcctctacttacggtggcttcatttccggttgccttacaggcggactcaactttcaggtcgagcatcacctgtttcctcgaatgtcctctgcctggtacccctacatcgctcctaccgttcgagaggtctgcaaaaagcacggcgtcaagtacgcctactatccctgggtgtggcagaacctcatctcgaccgtcaagtacctgcatcagtccggaactggctcgaactggaagaacggtgccaatccctactctggcaagctgtaa

SEQ ID NO: 76 - protein, 463 aa, Peridinium sp. CCMP626; identical to SEQ ID NO: 74

SEQ ID NO: 77 - DNA, 1362 bp, Euglena anabaena UTEX 373
  CDS (1)..(1362): delta-5 desaturase
  ref <302>: TITLE: DELTA-5 DESATURASES AND THEIR USE IN MAKING POLYUNSATURATED FATTY ACIDS
  ref <310>: PATENT DOCUMENT NUMBER: U.S. 2008-0274521-A1
  ref <311>: PATENT FILING DATE: 2008-04-29
  ref <312>: PUBLICATION DATE: 2008-11-06
  ref <313>: RELEVANT RESIDUES IN SEQ ID NO: (1)..(1362)
  ref <302>: TITLE: DELTA-5 DESATURASES AND THEIR USE IN MAKING POLYUNSATURATED FATTY ACIDS
  ref <310>: PATENT DOCUMENT NUMBER: WO 2008/137532
  ref <311>: PATENT FILING DATE: 2008-05-01
  ref <312>: PUBLICATION DATE: 2008-11-13
  ref <313>: RELEVANT RESIDUES IN SEQ ID NO: (1)..(1362)
atggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 78 - protein, 454 aa, Euglena anabaena UTEX 373
MATISLTTEQLLEHPELVAIDGVLYDLFGLAKVHPGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 79 - DNA, 1362 bp, Euglena anabaena UTEX 373
  CDS (1)..(1362): synthetic delta-5 desaturase (codon-optimized for Yarrowia lipolytica)
  ref <302>: TITLE: DELTA-5 DESATURASES AND THEIR USE IN MAKING POLYUNSATURATED FATTY ACIDS
  ref <310>: PATENT DOCUMENT NUMBER: U.S. 2008-0274521-A1
  ref <311>: PATENT FILING DATE: 2008-04-29
  ref <312>: PUBLICATION DATE: 2008-11-06
  ref <313>: RELEVANT RESIDUES IN SEQ ID NO: (1)..(1362)
  ref <302>: TITLE: DELTA-5 DESATURASES AND THEIR USE IN MAKING POLYUNSATURATED FATTY ACIDS
  ref <310>: PATENT DOCUMENT NUMBER: WO 2008/137532
  ref <311>: PATENT FILING DATE: 2008-05-01
  ref <312>: PUBLICATION DATE: 2008-11-13
  ref <313>: RELEVANT RESIDUES IN SEQ ID NO: (1)..(1362)
atggccaccatctccctgactaccgagcagctcctggaacaccccgagctcgttgccatcgacggagtcctgtacgatctcttcggtctggccaaggtgcatccaggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttc

SEQ ID NO: 80 - protein, 454 aa, Euglena anabaena UTEX 373; identical to SEQ ID NO: 78

SEQ ID NO: 81 - DNA, 1365 bp, Euglena anabaena UTEX 373
  CDS (1)..(1365): synthetic mutant delta-5 desaturase (codon-optimized for Yarrowia lipolytica)
atggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaa

SEQ ID NO: 82 - protein, 454 aa, Euglena anabaena UTEX 373
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 83 - DNA, 1086 bp, Phytophthora ramorum
  CDS (1)..(1086): delta-17 desaturase
  ref <302>: TITLE: DELTA-17 DESATURASES AND THEIR USE IN MAKING POLYUNSATURATED FATTY ACIDS
  ref <310>: PATENT DOCUMENT NUMBER: WO 2007/123999
  ref <311>: PATENT FILING DATE: 2007-04-19
  ref <312>: PUBLICATION DATE: 2007-11-01
  ref <313>: RELEVANT RESIDUES IN SEQ ID NO: (1)..(1086)
  ref <302>: TITLE: DELTA-17 DESATURASES AND THEIR USE IN MAKING POLYUNSATURATED FATTY ACIDS
  ref <310>: PATENT DOCUMENT NUMBER: US 2007-0249026-A1
  ref <311>: PATENT FILING DATE: 2007-04-18
  ref <312>: PUBLICATION DATE: 2007-10-25
  ref <313>: RELEVANT RESIDUES IN SEQ ID NO: (1)..(1086)
atggcgactaagcagccgtaccagttcccgaccctgacggagatcaagcggtcgctgcccagcgagtgctttgaggcctcggtgccgctgtcgctctactacacggtgcgcatcgtggccatcgccgtggcgctggcgttcggcctcaactacgcgcgcgcgctgcccgtggtcgagagcttgtgggcgctggacgctgcgctctgctgcggttacgtgctgctgcagggcatcgtgttctggggcttcttcacggtgggccatgacgccggccacggcgccttctcgcgttaccacctgctcaacttcgtggtgggcaccttcatccactcgctcatcctcacgcccttcgagtcgtggaagctcacgcaccgccaccaccacaagaacacgggcaacattgaccgcgacgagatcttctacccgcagcgcaaggccgacgaccacccgctgtcgcgcaacctcgtgctggcgctcggcgccgcgtggttcgcctacctggtcgagggcttcccgccccgcaaggtcaaccacttcaacccattcgagccgctgtttgtgcgccaggtggccgccgtcgtcatctcgctctccgcgcacttcgccgtgttggcgctgtccgtgtatctgagcttccagttcggtctcaagaccatggcgctctactactacggccccgtcttcgtgttcggcagcatgcttgtgatcaccaccttcctgcatcacaatgacgaggagaccccatggtacggagactccgactggacctacgtcaagggcaacctgtcgtccgtggaccggtcctacggcgcgttcatcgacaacctgagccacaacatcggcacgcaccagatccaccacctcttccccatcatcccgcactacaagctcaaccgcgctacggcggcattccaccaggccttccccgagctcgtgcgcaagagcgacgagccgatcctcaaggccttctggcgcgtcggccgactgtacgccaactacggcgtcgtggacccggacgccaagctcttcacgctcaaggaggccaaggcggcgtccgaggcggcgaccaagaccaaggccacctaa

SEQ ID NO: 84 - protein, 361 aa, Phytophthora ramorum
MATKQPYQFPTLTEIKRSLPSECFEASVPLSLYYTVRIVAIAVALAFGLNYARALPVVESLWALDAALCCGYVLLQGIVFWGFFTVGHDAGHGAFSRYHLLNFVVGTFIHSLILTPFESWKLTHRHHHKNTGNIDRDEIFYPQRKADDHPLSRNLVLALGAAWFAYLVEGFPPRKVNHFNPFEPLFVRQVAAVVISLSAHFAVLALSVYLSFQFGLKTMALYYYGPVFVFGSMLVITTFLHHNDEETPWYGDSDWTYVKGNLSSVDRSYGAFIDNLSHNIGTHQIHHLFPIIPHYKLNRATAAFHQAFPELVRKSDEPILKAFWRVGRLYANYGVVDPDAKLFTLKEAKAASEAATKTKAT

SEQ ID NO: 85 - DNA, 1086 bp, Phytophthora ramorum
  CDS (1)..(1086): synthetic delta-17 desaturase (codon-optimized for Yarrowia lipolytica)
  ref <302>: TITLE: DELTA-17 DESATURASES AND THEIR USE IN MAKING POLYUNSATURATED FATTY ACIDS
  ref <310>: PATENT DOCUMENT NUMBER: WO 2007/123999
  ref <311>: PATENT FILING DATE: 2007-04-19
  ref <312>: PUBLICATION DATE: 2007-11-01
  ref <313>: RELEVANT RESIDUES IN SEQ ID NO: (1)..(1086)
  ref <302>: TITLE: DELTA-17 DESATURASES AND THEIR USE IN MAKING POLYUNSATURATED FATTY ACIDS
  ref <310>: PATENT DOCUMENT NUMBER: US 2007-0249026-A1
  ref <311>: PATENT FILING DATE: 2007-04-18
  ref <312>: PUBLICATION DATE: 2007-10-25
  ref <313>: RELEVANT RESIDUES IN SEQ ID NO: (1)..(1086)
atggctaccaagcagccctaccagttccctactctgaccgagatcaagcgatctcttccctccgagtgctttgaagcctcggtccctctgtccttgtactacaccgtgcgaatcgtcgctattgccgttgctctggccttcggactcaactacgctcgagcccttcccgtggtcgagtctctgtgggcactcgacgctgccctttgttgcggttacgttctgctccaaggcattgtcttctggggattctttaccgtgggtcacgatgctggacatggtgccttctctcgataccacctgctcaactttgtcgttggcacctttatccactccctcattcttactcccttcgagtcgtggaagctcacacatcgacaccatcacaagaacaccggaaacatcgaccgagacgaaatcttctaccctcagcgaaaggccgacgatcatcctctgtctcgaaacctcgtcctggctctcggtgccgcttggtttgcctaccttgtcgagggctttcctccccgaaaggtcaaccacttcaaccccttcgaacctctgtttgtgcgacaggtggctgccgttgtcatttccctctctgctcacttcgccgtcctggcactgtccgtgtatctgagctttcagttcggtctcaagacaatggctctgtactactatggacccgtcttcgtgttcggctccatgctcgtcattactacctttctgcatcacaatgacgaggaaactccttggtacggagattccgactggacctacgtcaagggcaacttgtcttccgtggaccgatcttacggtgccttcatcgacaacctctcgcacaacattggcacacaccagatccaccatctgtttcccatcattcctcactacaagctcaaccgagccaccgctgccttccaccaggcctttcccgaacttgtccgaaagagcgacgagcccattctcaaggctttctggagagttggtcgactttacgccaactacggagtcgtggatcccgacgcaaagctgtttactctcaaggaggccaaagctgcctccgaggctgccaccaagaccaaggctacttaa

SEQ ID NO: 86 - protein, 361 aa, Phytophthora ramorum; identical to SEQ ID NO: 84

SEQ ID NO: 87 - DNA, 1080 bp, Pythium aphanidermatum
  CDS (1)..(1080): delta-17 desaturase
  ref <302>: TITLE: DELTA-17 DESATURASES AND THEIR USE IN MAKING POLYUNSATURATED FATTY ACIDS
  ref <310>: PATENT DOCUMENT NUMBER: WO 2008/054565
  ref <311>: PATENT FILING DATE: 2007-07-19
  ref <312>: PUBLICATION DATE: 2008-05-08
  ref <313>: RELEVANT RESIDUES IN SEQ ID NO: (1)..(1080)
  ref <302>: TITLE: DELTA-17 DESATURASES AND THEIR USE IN MAKING POLYUNSATURATED FATTY ACIDS
  ref <310>: PATENT DOCUMENT NUMBER: US 2008-0125326-A1
  ref <311>: PATENT FILING DATE: 2007-07-19
  ref <312>: PUBLICATION DATE: 2008-05-29
  ref <313>: RELEVANT RESIDUES IN SEQ ID NO: (1)..(1080)
atggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactag

SEQ ID NO: 88 - protein, 359 aa, Pythium aphanidermatum
MASSTVAAPYEFPTLTEIKRSLPAHCFEASVPWSLYYTVRALGIAGSLALGLYYARALAIVQEFALLDAVLCTGYILLQGIVFWGFFTIGHDCGHGAFSRSHLLNFSVGTLIHSIILTPYESWKISHRHHHKNTGNIDKDEIFYPQREADSHPLSRHMVISLGSAWFAYLVAGFPPRKVNHFNPWEPLYLRRMSAVIISLGSLVAFAGLYAYLTYVYGLKTMALYYFAPLFGFATMLVVTTFLHHNDEETPWYADSEWTYVKGNLSSVDRSYGALIDNLSHNIGTHQIHHLFPIIPHYKLNEATAAFAQAFPELVRKSASPIIPTFIRIGLMYAKYGVVDKDAKMFTLKEAKAAKTKAN

SEQ ID NO: 89 - DNA, 1080 bp, Pythium aphanidermatum
  CDS (1)..(1080): synthetic delta-17 desaturase (codon-optimized for Yarrowia lipolytica)
  ref <302>: TITLE: DELTA-17 DESATURASES AND THEIR USE IN MAKING POLYUNSATURATED FATTY ACIDS
  ref <310>: PATENT DOCUMENT NUMBER: WO 2008/054565
  ref <311>: PATENT FILING DATE: 2007-07-19
  ref <312>: PUBLICATION DATE: 2008-05-08
  ref <313>: RELEVANT RESIDUES IN SEQ ID NO: (1)..(1080)
  ref <302>: TITLE: DELTA-17 DESATURASES AND THEIR USE IN MAKING POLYUNSATURATED FATTY ACIDS
  ref <310>: PATENT DOCUMENT NUMBER: US 2008-0125326-A1
  ref <311>: PATENT FILING DATE: 2007-07-19
  ref <312>: PUBLICATION DATE: 2008-05-29
  ref <313>: RELEVANT RESIDUES IN SEQ ID NO: (1)..(1080)
atggcttcctctaccgttgccgctccctacgagttccctactctcaccgagatcaagcgatccctgcctgcccactgcttcgaagcctctgttccctggtccctctactataccgtgcgagctctgggcattgccggttcccttgctctcggactgtactatgctcgagcccttgctatcgtgcaggagtttgcactgctcgatgccgtcctttgcactggctacattctgctccagggtatcgtgttctggggattctttaccatcggtcacgactgtggacatggtgccttctcgcgatcccacctgctcaacttctctgttggcacactcattcactccatcattctgactccctacgagtcgtggaagatcagccatcgacaccatcacaagaacaccggcaacatcgacaaggatgagatcttctaccctcagcgagaagccgactctcatcccctgtcccgacacatggtcatctcccttggttcggcttggtttgcctacctcgttgctggatttcctccccgaaaggtcaaccacttcaatccctgggagcctctctacctgcgaagaatgtctgccgtcatcatttccctcggctctctcgtggcctttgctggtctgtacgcctaccttacctacgtctacggcctcaagaccatggctctgtattacttcgcacctctctttggattcgccaccatgctggttgtcactaccttcctccatcacaacgacgaggaaactccctggtacgccgattcggagtggacctatgtcaagggcaacttgtcctctgtggaccgaagctacggagccctcatcgacaacctgtcccacaacattggtacacatcagatccaccatctgtttcccatcattcctcactacaagctcaacgaggccactgctgccttcgctcaggcctttcccgaactggtgcgaaagtcggcttctcccatcattcccaccttcatccgaattggtcttatgtacgccaagtacggcgtggtcgacaaggatgccaagatgtttaccctcaaggaggccaaggctgccaagaccaaagccaactaa

SEQ ID NO: 90 - protein, 359 aa, Pythium aphanidermatum; identical to SEQ ID NO: 88

SEQ ID NO: 91 - DNA, 1434 bp, Fusarium monoliforme
  CDS (1)..(1434): delta-12 desaturase
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: WO 2005/047485
  ref <311>: PATENT FILING DATE: 2004-11-12
  ref <312>: PUBLICATION DATE: 2005-05-26
  ref <313>: RELEVANT RESIDUES IN SEQ ID NO: (1)..(1434)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: U.S. 7,504,259
  ref <311>: PATENT FILING DATE: 2004-11-10
  ref <312>: PUBLICATION DATE: 2009-03-17
  ref <313>: RELEVANT RESIDUES IN SEQ ID NO: (1)..(1434)
atggcgtccacttcggctctgcccaagcagaaccctgcgcttagacgcaccgtcacctcaactactgtgacggattctgagtctgccgccgtctctccttcagactctccccgccactcggcctcttccacatcgctctcgtccatgtccgaggttgatatcgccaagcccaagtccgagtatggtgtcatgctcgacacctacggcaaccagttcgaggttcccgactttaccatcaaggacatctacaatgccatccctaagcactgcttcaagcgctccgctctcaagggatacggttatatcctccgcgacattgtcctcctgactaccactttcagcatctggtacaactttgtgacccccgaatatatcccctccacccccgcccgcgctggtctgtgggccgtgtacaccgttcttcagggtcttttcggtactggtctctgggttattgcccatgagtgcggtcacggtgctttctccgattctcgcatcatcaacgacattactggctgggttcttcactcttccctccttgtcccctacttcagctggcaaatctcccaccgaaagcaccacaaggccactggcaacatggagcgtgacatggtcttcgttccccgaacccgcgagcagcaggctactcgtctcggaaagatgacccacgagctcgctcatcttactgaggagacccccgctttcactcttctcatgctcgtccttcagcagctcgttggctggcccaactacctcatcaccaatgttaccggccacaactaccacgagcgccagcgtgagggtcgcggcaagggcaagcataacggcctcggcggtggtgttaaccacttcgatccccgcagccctctgtacgagaacagtgacgctaagctcatcgtcctcagcgatattggtatcggtctgatggccactgctctgtacttcctcgttcagaagttcggtttctacaacatggccatctggtactttgttccctacctctgggttaaccactggctcgttgccatcaccttcctccagcacaccgaccctacccttccccactacaccaacgacgagtggaacttcgtccgtggtgccgctgctaccattgaccgtgagatgggcttcatcggccgccaccttctccacggcatcatcgagactcatgtcctccaccactacgtcagcagcatccccttctacaacgcggacgaggccaccgaggccattaagcccatcatgggcaagcactaccgggctgatgtccaggatggtcctcgtggcttcatccgcgccatgtaccgcagtgcgcgtatgtgccagtgggttgagcccagcgctggtgccgagggtgctggtaagggtgttctgttcttccgcaaccgcaacaacgtgggcaccccccccgctgttatcaagcccgttgcttaa

SEQ ID NO: 92 - protein, 477 aa, Fusarium monoliforme
MASTSALPKQNPALRRTVTSTTVTDSESAAVSPSDSPRHSASSTSLSSMSEVDIAKPKSEYGVMLDTYGNQFEVPDFTIKDIYNAIPKHCFKRSALKGYGYILRDIVLLTTTFSIWYNFVTPEYIPSTPARAGLWAVYTVLQGLFGTGLWVIAHECGHGAFSDSRIINDITGWVLHSSLLVPYFSWQISHRKHHKATGNMERDMVFVPRTREQQATRLGKMTHELAHLTEETPAFTLLMLVLQQLVGWPNYLITNVTGHNYHERQREGRGKGKHNGLGGGVNHFDPRSPLYENSDAKLIVLSDIGIGLMATALYFLVQKFGFYNMAIWYFVPYLWVNHWLVAITFLQHTDPTLPHYTNDEWNFVRGAAATIDREMGFIGRHLLHGIIETHVLHHYVSSIPFYNADEATEAIKPIMGKHYRADVQDGPRGFIRAMYRSARMCQWVEPSAGAEGAGKGVLFFRNRNNVGTPPAVIKPVA

SEQ ID NO: 93 - DNA, 1434 bp, Fusarium moniliforme
  CDS (1)..(1434): synthetic delta-12 desaturase (codon-optimized for Yarrowia lipolytica)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: WO 2005/047485
  ref <311>: PATENT FILING DATE: 2004-11-12
  ref <312>: PUBLICATION DATE: 2005-05-26
  ref <313>: RELEVANT RESIDUES IN SEQ ID NO: (1)..(1434)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: U.S. 7,504,259
  ref <311>: PATENT FILING DATE: 2004-11-10
  ref <312>: PUBLICATION DATE: 2009-03-17
  ref <313>: RELEVANT RESIDUES IN SEQ ID NO: (1)..(1434)
atggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaa

SEQ ID NO: 94 - protein, 477 aa, Fusarium moniliforme; identical to SEQ ID NO: 92

SEQ ID NO: 95 - DNA, 828 bp, Mortierella alpina
  CDS (1)..(828): C16/18 elongase
  ref <302>: TITLE: A MORTIERELLA ALPINA C16/18 FATTY ACID ELONGASE
  ref <310>: PATENT DOCUMENT NUMBER: WO 2007/046817
  ref <311>: PATENT FILING DATE: 2005-11-04
  ref <312>: PUBLICATION DATE: 2007-04-26
  ref <313>: RELEVANT RESIDUES IN SEQ ID NO: (1)..(828)
  ref <302>: TITLE: A MORTIERELLA ALPINA C16/18 FATTY ACID ELONGASE
  ref <310>: PATENT DOCUMENT NUMBER: US 2007-0087420-A1
  ref <311>: PATENT FILING DATE: 2005-10-19
  ref <312>: PUBLICATION DATE: 2007-04-19
  ref <313>: RELEVANT RESIDUES IN SEQ ID NO: (1)..(828)
atggagtctggacctatgcctgccgggatccccttccctgaatactatgactttttcatggactggaagacacccctggcaattgctgccacctacaccgccgctgttgggctcttcaaccccaaggttggcaaagtctcgcgcgtggtagccaagtcggctaacgccaagccggcagagcgcacgcagtccggcgccgccatgaccgcctttgtctttgtccacaaccttatcctctgcgtgtactctggaatcaccttctactacatgttcccagccatggtcaagaactttagaacacataccctccatgaggcctactgcgatacggatcagagcctgtggaacaacgcccttggctactggggctacctcttctacctttcaaagttttacgaggtcattgacaccatcatcatcatcttgaaggggcgccgctcgtccctgctccagacctaccaccacgccggcgctatgatcaccatgtggtccggcatcaactaccaggcaacgcccatttggatttttgtcgtcttcaactcgttcatccacaccatcatgtactgttactatgccttcacctcaatcggcttccaccccccaggcaagaagtacctcacctccatgcagatcacccagtttttggtcggcatcactatcgccgtctcttatctcttcgtccctggatgtatccgcacacccggtgctcagatggctgtctggatcaacgtcggatacctctttcccctcacttatctctttgtggattttgccaagcgtacttactccaagcgtagtgccatcgccgctcagaagaaggcccagtaa

SEQ ID NO: 96 - protein, 275 aa, Mortierella alpina
MESGPMPAGIPFPEYYDFFMDWKTPLAIAATYTAAVGLFNPKVGKVSRVVAKSANAKPAERTQSGAAMTAFVFVHNLILCVYSGITFYYMFPAMVKNFRTHTLHEAYCDTDQSLWNNALGYWGYLFYLSKFYEVIDTIIIILKGRRSSLLQTYHHAGAMITMWSGINYQATPIWIFVVFNSFIHTIMYCYYAFTSIGFHPPGKKYLTSMQITQFLVGITIAVSYLFVPGCIRTPGAQMAVWINVGYLFPLTYLFVDFAKRTYSKRSAIAAQKKAQ

SEQ ID NO: 97 - DNA, 828 bp, Mortierella alpina
  CDS (1)..(828): synthetic C16/18 elongase (codon-optimized for Yarrowia lipolytica)
  ref <302>: TITLE: A MORTIERELLA ALPINA C16/18 FATTY ACID ELONGASE
  ref <310>: PATENT DOCUMENT NUMBER: U.S. 7,470,532
  ref <311>: PATENT FILING DATE: 2005-10-19
  ref <312>: PUBLICATION DATE: 2008-12-30
  ref <313>: RELEVANT RESIDUES IN SEQ ID NO: (1)..(828)
  ref <302>: TITLE: A MORTIERELLA ALPINA C16/18 FATTY ACID ELONGASE
  ref <310>: PATENT DOCUMENT NUMBER: WO 2007/046817
  ref <311>: PATENT FILING DATE: 2005-11-04
  ref <312>: PUBLICATION DATE: 2007-04-26
  ref <313>: RELEVANT RESIDUES IN SEQ ID NO: (1)..(828)
atggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaa

SEQ ID NO: 98 - protein, 275 aa, Mortierella alpina; identical to SEQ ID NO: 96

SEQ ID NO: 99 - protein, 12 aa, Artificial Sequence
  membrane bound O-acyltransferase motif
  misc_feature (4)..(6): Xaa can be any naturally occurring amino acid
  misc_feature (9)..(11): Xaa can be any naturally occurring amino acid
  ref <301>: AUTHORS: Hideo Shindou, Miki Etoa, Ryo Morimotoa and Takao Shimizua
  ref <302>: TITLE: Identification of membrane O-acyltransferase family motifs
  ref <303>: JOURNAL: Biochemical and Biophysical Research Communications
  ref <304>: VOLUME: 383
  ref <305>: ISSUE: 3
  ref <306>: PAGES: 320-325
  ref <307>: DATE: 2009-04-08
  ref <313>: RELEVANT RESIDUES IN SEQ ID NO: (1)..(12)
WHGXXXGYXXXF

SEQ ID NO: 100 - protein, 6 aa, Artificial Sequence
  membrane bound O-acyltransferase motif
  misc_feature (2)..(5): Xaa can be any naturally occurring amino acid
  ref <301>: AUTHORS: Hideo Shindou, Miki Etoa, Ryo Morimotoa and Takao Shimizua
  ref <302>: TITLE: Identification of membrane O-acyltransferase family motifs
  ref <303>: JOURNAL: Biochemical and Biophysical Research Communications
  ref <304>: VOLUME: 383
  ref <305>: ISSUE: 3
  ref <306>: PAGES: 320-325
  ref <307>: DATE: 2009-04-08
  ref <313>: RELEVANT RESIDUES IN SEQ ID NO: (1)..(6)
YXXXXF

SEQ ID NO: 101 - protein, 9 aa, Artificial Sequence
  membrane bound O-acyltransferase motif
  misc_feature (2)..(4): Xaa can be any naturally occurring amino acid
  misc_feature (7)..(8): Xaa can be any naturally occurring amino acid
  ref <301>: AUTHORS: Hideo Shindou, Miki Etoa, Ryo Morimotoa and Takao Shimizua
  ref <302>: TITLE: Identification of membrane O-acyltransferase family motifs
  ref <303>: JOURNAL: Biochemical and Biophysical Research Communications
  ref <304>: VOLUME: 383
  ref <305>: ISSUE: 3
  ref <306>: PAGES: 320-325
  ref <307>: DATE: 2009-04-08
  ref <313>: RELEVANT RESIDUES IN SEQ ID NO: (1)..(9)
YXXXYFXXH

SEQ ID NO: 102 - protein, 15 aa, Artificial Sequence
  motif
  MISC_FEATURE (2)..(2): Xaa = Val [V] or Ile [I]
  MISC_FEATURE (3)..(3): Xaa = Leu [L] or Ile [I]
  misc_feature (4)..(5): Xaa can be any naturally occurring amino acid
  MISC_FEATURE (7)..(7): Xaa = Leu [L] or Ile [I] or Val [V]
  misc_feature (8)..(13): Xaa can be any naturally occurring amino acid
  ref <302>: TITLE: GENES ENCODING A NOVEL TYPE OF LYSOPHOPHATIDYLCHOLINE ACYLTRANSFERASES AND THEIR USE TO INCREASE TRIACYLGLYCEROL PRODUCTION AND/OR MODIFY FATTY ACID COMPOSITION
  ref <310>: PATENT DOCUMENT NUMBER: U.S. Patent Publication No. 2008-0145867-A1
  ref <311>: PATENT FILING DATE: 2007-06-15
  ref <312>: PUBLICATION DATE: 2008-06-19
  ref <313>: RELEVANT RESIDUES IN SEQ ID NO: (1)..(15)
MXXXXKXXXXXXXDG

SEQ ID NO: 103 - protein, 24 aa, Artificial Sequence
  motif
  misc_feature (2)..(2): Xaa can be any naturally occurring amino acid
  misc_feature (6)..(7): Xaa can be any naturally occurring amino acid
  misc_feature (9)..(11): Xaa can be any naturally occurring amino acid
  MISC_FEATURE (12)..(12): Xaa = Glu [E] or Asp [D]
  MISC_FEATURE (13)..(13): Xaa = Ala [A] or Gly [G]
  misc_feature (14)..(18): Xaa can be any naturally occurring amino acid
  misc_feature (20)..(20): Xaa can be any naturally occurring amino acid
  MISC_FEATURE (22)..(22): Xaa = Phe [F] or Tyr [Y]
  misc_feature (23)..(23): Xaa can be any naturally occurring amino acid
  ref <302>: TITLE: GENES ENCODING A NOVEL TYPE OF LYSOPHOPHATIDYLCHOLINE ACYLTRANSFERASES AND THEIR USE TO INCREASE TRIACYLGLYCEROL PRODUCTION AND/OR MODIFY FATTY ACID COMPOSITION
  ref <310>: PATENT DOCUMENT NUMBER: U.S. Patent Publication No. 2008-0145867-A1
  ref <311>: PATENT FILING DATE: 2007-06-15
  ref <312>: PUBLICATION DATE: 2008-06-19
  ref <313>: RELEVANT RESIDUES IN SEQ ID NO: (1)..(15)
RXKYYXXWXXXXXXXXXXGXGXXG

SEQ ID NO: 104 - protein, 15 aa, Artificial Sequence
  motif
  misc_feature (3)..(3): Xaa can be any naturally occurring amino acid
  misc_feature (7)..(8): Xaa can be any naturally occurring amino acid
  misc_feature (12)..(13): Xaa can be any naturally occurring amino acid
  MISC_FEATURE (14)..(14): Xaa = Thr [T] or Phe [F]
  ref <302>: TITLE: GENES ENCODING A NOVEL TYPE OF LYSOPHOPHATIDYLCHOLINE ACYLTRANSFERASES AND THEIR USE TO INCREASE TRIACYLGLYCEROL PRODUCTION AND/OR MODIFY FATTY ACID COMPOSITION
  ref <310>: PATENT DOCUMENT NUMBER: U.S. Patent Publication No. 2008-0145867-A1
  ref <311>: PATENT FILING DATE: 2007-06-15
  ref <312>: PUBLICATION DATE: 2008-06-19
  ref <313>: RELEVANT RESIDUES IN SEQ ID NO: (1)..(15)
SAXWHGXXPGYXXXF

SEQ ID NO: 105 - protein, 7 aa, Artificial Sequence
  1-acyl-sn-glycerol-3-phosphate acyltransferase motif
  misc_feature (2)..(3): Xaa can be any naturally occurring amino acid
  MISC_FEATURE (6)..(6): Xaa = Asp [D] or Arg [R]
  ref <301>: AUTHORS: Tal M. Lewin, Ping Wang, and Rosalind A. Coleman
  ref <302>: TITLE: Analysis of Amino Acid Motifs Diagnostic for the sn-Glycerol-3-phosphate Acyltransferase Reaction
  ref <303>: JOURNAL: Biochemistry
  ref <304>: VOLUME: 38
  ref <305>: ISSUE: 18
  ref <306>: PAGES: 57645771
  ref <307>: DATE: 1999-04-15
  ref <313>: RELEVANT RESIDUES IN SEQ ID NO: (1)..(7)
  ref <301>: AUTHORS: Atsushi Yamashita, Hiroki Nakanishia, Hiroshi Suzukia, Ryo Kamataa, Ken Tanakaa, Keizo Wakua and Takayuki Sugiura
  ref <302>: TITLE: Topology of acyltransferase motifs and substrate specificity and accessibility in 1-acyl-sn-glycero-3-phosphate acyltransferase 1
  ref <303>: JOURNAL: Biochimica et Biophysica Acta
  ref <304>: VOLUME: 1771
  ref <305>: ISSUE: 9
  ref <306>: PAGES: 1202-1215
  ref <307>: DATE: 2007-07-17
  ref <313>: RELEVANT RESIDUES IN SEQ ID NO: (1)..(7)
GXXFIXR

SEQ ID NO: 106 - protein, 6 aa, Artificial Sequence
  1-acyl-sn-glycerol-3-phosphate acyltransferase motif
  MISC_FEATURE (1)..(1): Xaa = Val [V] or Ile [I]
  MISC_FEATURE (2)..(2): Xaa = Pro [P] or Xaa
  MISC_FEATURE (3)..(3): Xaa = Ile [I] or Val [V] or Leu [L]
  MISC_FEATURE (4)..(4): Xaa = Ile [I] or Val [V]
  MISC_FEATURE (6)..(6): Xaa =  Val [V] or Ile [I]
  ref <301>: AUTHORS: Atsushi Yamashita, Hiroki Nakanishia, Hiroshi Suzukia, Ryo Kamataa, Ken Tanakaa, Keizo Wakua and Takayuki Sugiura
  ref <302>: TITLE: Topology of acyltransferase motifs and substrate specificity and accessibility in 1-acyl-sn-glycero-3-phosphate acyltransferase 1
  ref <303>: JOURNAL: Biochimica et Biophysica Acta
  ref <304>: VOLUME: 1771
  ref <305>: ISSUE: 9
  ref <306>: PAGES: 1202-1215
  ref <307>: DATE: 2007-07-17
  ref <313>: RELEVANT RESIDUES IN SEQ ID NO: (1)..(6)
XXXXPX

SEQ ID NO: 107 - protein, 6 aa, Artificial Sequence
  1-acyl-sn-glycerol-3-phosphate acyltransferase motif
  ref <301>: AUTHORS: Atsushi Yamashita, Hiroki Nakanishia, Hiroshi Suzukia, Ryo Kamataa, Ken Tanakaa, Keizo Wakua and Takayuki Sugiura
  ref <302>: TITLE: Topology of acyltransferase motifs and substrate specificity and accessibility in 1-acyl-sn-glycero-3-phosphate acyltransferase 1
  ref <303>: JOURNAL: Biochimica et Biophysica Acta
  ref <304>: VOLUME: 1771
  ref <305>: ISSUE: 9
  ref <306>: PAGES: 1202-1215
  ref <307>: DATE: 2007-07-17
  ref <313>: RELEVANT RESIDUES IN SEQ ID NO: (1)..(6)
IVPIVM

SEQ ID NO: 108 - protein, 1024 aa, Yarrowia lipolytica
  MISC_FEATURE (1)..(1024): YlPex1p;  GenBank Accession No. CAG82178
MTSKSDYSGKDKIELDPVFAKSIDLLPNTQVVIDIQLNPKIAHTIHLEPVTVADWEIVELHAAYLESRMINQVRAVSPNQPVTVYPSSTTSATLKVIRIEPDLGAAGFAKLSPDSEVVVAPKQRKKEEKQVKKRSGSARSTGSQKRKGGRGPHALRRAISEDFDGHLRLEVSLDVSQLPPEFHQLKNVSIKVITPPNLASPQQAASIAVEEKSEESLSQNKPPSSEPKVEVPPDIINPASEIVATLVNDTTSPTGHAKLSYALADALGIPSSVGHVIRFESASKPLSQKPGALVIHRFITKTVGAAEQKSLRLKGEKNADDGVSADDQFSLLEELKKLQMLEGPITNFQRLPPIPELLPLGGVIGLQNSEGWIQGGYLGEEPIPFVSGSEILRSESSLSPSNIESEDKRVVGLDNMLNKINEVLSRDSIGCLVYGSRGSGKSAVLNHIKKECKVSHTHTVSIACGLIAQDRVQAVREILTKAFLEASWFSPSVLFLDDIDALMPAEVEHADSSRTRQLTQLFLELALPIMKSRHVSVVASAQAKESLHMNLVTGHVFEELFHLKSPDKEARLAILSEAVKLMDQNVSFSQNDVLEIASQVDGYLPGDLWTLSERAQHEMALRQIEIGLENPSIQLADFMKALEDFVPSSLRGVKLQKSNVKWNDIGGLKETKAVLLETLEWPTKYAPIFASCPLRLRSGLLLYGYPGCGKTYLASAVAAQCGLNFISIKGPEILNKYIGASEQSVRELFERAQAAKPCILFFDEFDSIAPKRGHDSTGVTDRVVNQMLTQMDGAEGLDGVYVLAATSRPDLIDPALLRPGRLDKMLICDLPSYEDRLDILRAIVDGKMHLDGEVELEYVASRTDGFSGADLQAVMFNAYLEAIHEVVDVADDTAADTPALEDKRLEFFQTTLGDAKKDPAAVQNEVMNARAAVAEKARVTAKLEALFKGMSVGVDNDDDKPRKKAVVVIKPQHMNKSLDETSPSISKKELLKLKGIYSQFVSGRSGDMPPGTASTDVGGRATLA

SEQ ID NO: 109 - protein, 381 aa, Yarrowia lipolytica
  MISC_FEATURE (1)..(381): YlPex2p; GenBank Accession No. CAG77647
MSSVLRLFKIGAPVPNVRVHQLDASLLDAELVDLLKNQLFKGFTNFHPEFRDKYESELVLALKLILFKLTVWDHAITYGGKLQNLKFIDSRHSSKLQIQPSVIQKLGYGILVVGGGYLWSKIEGYLLARSEDDVATDGTSVRGASAARGALKVANFASLLYSAATLGNFVAFLYTGRYATVIMRLLRIRLVPSQRTSSRQVSYEFQNRQLVWNAFTEFLIFILPLLQLPKLKRRIERKLQSLNVTRVGNVEEASEGELAHLPQKTCAICFRDEEEQEGGGGASHYSTDVTNPYQADCGHVYCYVCLVTKLAQGDGDGWNCYRCAKQVQKMKPWVDVDEAAVVGAAEMHEKVDVIEHAEDNEQEEEEFDDDDEDSNFQLMKD

SEQ ID NO: 110 - protein, 431 aa, Yarrowia lipolytica
  MISC_FEATURE (1)..(431): YlPex3p; GenBank Accession No. CAG78565
MDFFRRHQKKVLALVGVALSSYLFIDYVKKKFFEIQGRLSSERTAKQNLRRRFEQNQQDADFTIMALLSSLTTPVMERYPVDQIKAELQSKRRPTDRVLALESSTSSSATAQTVPTMTSGATEEGEKSKTQLWQDLKRTTISRAFSLVYADALLIFFTRLQLNILGRRNYVNSVVALAQQGREGNAEGRVAPSFGDLADMGYFGDLSGSSSFGETIVDPDLDEQYLTFSWWLLNEGWVSLSERVEEAVRRVWDPVSPKAELGFDELSELIGRTQMLIDRPLNPSSPLNFLSQLLPPREQEEYVLAQNPSDTAAPIVGPTLRRLLDETADFIESPNAAEVIERLVHSGLSVFMDKLAVTFGATPADSGSPYPVVLPTAKVKLPSILANMARQAGGMAQGSPGVENEYIDVMNQVQELTSFSAVVYSSFDWAL

SEQ ID NO: 111 - protein, 395 aa, Yarrowia lipolytica
  MISC_FEATURE (1)..(395): YlPex3Bp; GenBank Accession No. CAG83356
MLQSLNRNKKRLAVSTGLIAVAYVVISYTTKRLIEKQEQKLEEERAKERLKQLFAQTQNEAAFHTASVLPQLCEQIMEFVAVEKIAEQLQNMRAEKRKKQNMDDDKHSVLSLGTETTASMADGQKMSKIQLWDELKIESLTRIVTLIYCVSLLNYLIRLQTNIVGRKRYQNEAGPAGATYDMSLEQCYTWLLTRGWKSVVDNVRRSVQQVFTGVNPRQNLSLDEFATLLKRVQTLVNSPPYSTTPNTFLTSLLPPRELEQLRLEKEKQSLSPNYTYGSPLKDLVFESAQHIQSPQGMSSFRAIIDQSFKVFLEKVNESQYVNPPSTGGKRIAVGALQPPIISGGPKKVKLASLLSVATRQSSVISHAQPNPYVDAINSVAEYNGLCAVIYSSFEQ

SEQ ID NO: 112 - protein, 153 aa, Yarrowia lipolytica
  MISC_FEATURE (1)..(153): YlPex4p; GenBank Accession No. CAG79130
MASQKRLIKELAAYKKDPNPCLASLTADGDSLYKWTAVMRGTEGTAYENGLWQVEINIPENYPLQPPTMFFRTKICHPNIHFETGEVCIDVLKTQWSPAWTISSACTAVSAMLSLPEPDSPLNIDAANLVRCGDESAMEGLVRYYVNKYASGN

SEQ ID NO: 113 - protein, 598 aa, Yarrowia lipolytica
  MISC_FEATURE (1)..(598): YlPex5p; GenBank Accession No. CAG78803
MSFMRGGSECSTGRNPLSQFTKHTAEDRSLQHDRVAGPSGGRVGGMRSNTGEMSQQDREMMARFGAAGPEQSSFNYEQMRHELHNMGAQGGQIPQVPSQQGAANGGQWARDFGGQQTAPGAAPQDAKNWNAEFQRGGSPAEAMQQQGPGPMQGGMGMGGMPMYGMARPMYSGMSANMAPQFQPQQANARVVELDEQNWEEQFKQMDSAVGKGKEVEEQTAETATATETVTETETTTEDKPMDIKNMDFENIWKNLQVNVLDNMDEWLEETNSPAWERDFHEYTHNRPEFADYQFEENNQFMEHPDPFKIGVELMETGGRLSEAALAFEAAVQKNTEHAEAWGRLGACQAQNEKEDPAIRALERCIKLEPGNLSALMNLSVSYTNEGYENAAYATLERWLATKYPEVVDQARNQEPRLGNEDKFQLHSRVTELFIRAAQLSPDGANIDADVQVGLGVLFYGNEEYDKAIDCFNAAIAVRPDDALLWNRLGATLANSHRSEEAIDAYYKALELRPSFVRARYNLGVSCINIGCYKEAAQYLLGALSMHKVEGVQDDVLANQSTNLYDTLKRVFLGMDRRDLVAKVGNGMDVNQFRNEFEF

SEQ ID NO: 114 - protein, 1024 aa, Yarrowia lipolytica
  MISC_FEATURE (1)..(1024): YlPex6p; GenBank Accession No. CAG82306
MPSISHKPITAKLVAAPDATKLELSSYLYQQLFSDKPAEPYVAFEAPGIKWALYPASEDRSLPQYTCKADIRHVAGSLKKFMPVVLKRVNPVTIEHAIVTVPASQYETLNTPEQVLKALEPQLDKDRPVIRQGDVLLNGCRVRLCEPVNQGKVVKGTTKLTVAKEQETIQPADEAADVAFDIAEFLDFDTSVAKTRESTNLQVAPLEGAIPTPLSDRFDDCESRGFVKSETMSKLGVFSGDIVSIKTKNGAERVLRLFAYPEPNTVKYDVVYVSPILYHNIGDKEIEVTPNGETHKSVGEALDSVLEAAEEVKLARVLGPTTTDRTFQTAYHAGLQAYFKPVKRAVRVGDLIPIPFDSILARTIGEDPEMSHIPLEALAVKPDSVAWFQVTSLNGSEDPASKQYLVDSSQTKLIEGGTTSSAVIPTSVPWREYLGLDTLPKFGSEFAYADKIRNLVQISTSALSHAKLNTSVLLHSAKRGVGKSTVLRSVAAQCGISVFEISCFGLIGDNEAQTLGTLRAKLDRAYGCSPCVVVLQHLESIAKKSDQDGKDEGIVSKLVDVLADYSGHGVLLAATSNDPDKISEAIRSRFQFEIEIGVPSEPQRRQIFSHLTKSGPGGDSIRNAPISLRSDVSVENLALQSAGLTPPDLTAIVQTTRLRAIDRLNKLTKDSDTTLDDLLTLSHGTLQLTPSDFDDAIADARQKYSDSIGAPRIPNVGWDDVGGMEGVKKDILDTIETPLKYPHWFSDGVKKRSGILFYGPPGTGKTLLAKAIATTFSLNFFSVKGPELLNMYIGESEANVRRVFQKARDAKPCVVFFDELDSVAPQRGNQGDSGGVMDRIVSQLLAELDGMSTAGGEGVFVVGATNRPDLLDEALLRPGRFDKMLYLGISDTHEKQQTIMEALTRKFRLAADVSLEAISKRCPFTFTGADFYALCSDAMLNAMTRTANEVDAKIKLLNKNREEAGEEPVSIRWWFDHEATKSDIEVEVAQQDFEKAKDELSPSVSAEELQHYLKLRQQFEGGKK

SEQ ID NO: 115 - protein, 356 aa, Yarrowia lipolytica
  MISC_FEATURE (1)..(356): YlPex7p; GenBank Accession No. CAG78389
MLGFKTQGFNGYAANYSPFFNDKIAVGTAANYGLVGNGKLFILGISPEGRMVCEGQFDTQDGIFDVAWSEQHENHVATACGDGSVKLFDIKAGAFPLVSFKEHTREVFSVNWNMANKALFCTSSWDSTIKIWTPERTNSIMTLGQPAPAQGTNASAHIGRQTAPNQAAAQECIYSAKFSPHTDSIIASAHSTGMVKVWDTRAPQPLQQQFSTQQTESGGPPEVLSLDWNKYRPTVIATGGVDRSVQVYDIRMTQPAANQPVQPLSLILGHRLPVRGVSWSPHHADLLLSCSYDMTARVWRDASTGGNYLARQRGGTEVKCMDRHTEFVIGGDWSLWGDPGWITTVGWDQMVYVWHA

SEQ ID NO: 116 - protein, 671 aa, Yarrowia lipolytica
  MISC_FEATURE (1)..(671): YlPex8p; GenBank Accession No. CAG80447
MNKYLVPPPQANRTVTNLDLLINNLRGSSTPGAAEVDTRDILQRIVFILPTIKNPLNLDLVIKEIINSPRLLPPLIDLHDYQQLTDAFRATIKRKALVTDPTISFEAWLETCFQVITRFAGPGWKKLPLLAGLILADYDISADGPTLERKPGFPSKLKHLLKREFVTTFDQCLSIDTRNRSDATKWVPVLACISIAQVYSLLGDVAINYRRFLQVGLDLIFSNYGLEMGTALARLHAESGGDATTAGGLIGKKLKEPVVALLNTFAHIASSCIVHVDIDYIDRIQNKIILVCENQAETWRILTIESPTVMHHQESVQYLKWELFTLCIIMQGIANMLLTQKMNQFMYLQLAYKQLQALHSIYFIVDQMGSQFAAYDYVFFSAIDVLLSEYAPYIKNRGTIPPNKEFVAERLAANLAGTSNVGSHLPIDRSRVLFALNYYEQLVTVCHDSCVETIIYPMARSFLYPTSDIQQLKPLVEAAHSVILAGLAVPTNAVVNAKLIPEYMGGVLPLFPGVFSWNQFVLAIQSIVNTVSPPSEVFKTNQKLFRLVLDSLMKKCRDTPVGIPVPHSVTVSQEQEDIPPTQRAVVMLALINSLPYVDIRSFELWLQETWNMIEATPMLAENAPNKELAHAEHEFLVLEMWKMISGNIDQRLNDVAIRWWYKKNARVHGTL

SEQ ID NO: 117 - protein, 377 aa, Yarrowia lipolytica
  MISC_FEATURE (1)..(377): YlPex10p; GenBank Accession No. CAG81606
MWGSSHAFAGESDLTLQLHTRSNMSDNTTIKKPIRPKPIRTERLPYAGAAEIIRANQKDHYFESVLEQHLVTFLQKWKGVRFIHQYKEELETASKFAYLGLCTLVGSKTLGEEYTNLMYTIRDRTALPGVVRRFGYVLSNTLFPYLFVRYMGKLRAKLMREYPHLVEYDEDEPVPSPETWKERVIKTFVNKFDKFTALEGFTAIHLAIFYVYGSYYQLSKRIWGMRYVFGHRLDKNEPRIGYEMLGLLIFARFATSFVQTGREYLGALLEKSVEKEAGEKEDEKEAVVPKKKSSIPFIEDTEGETEDKIDLEDPRQLKFIPEASRACTLCLSYISAPACTPCGHFFCWDCISEWVREKPECPLCRQGVREQNLLPIR

SEQ ID NO: 118 - protein, 408 aa, Yarrowia lipolytica
  MISC_FEATURE (1)..(408): YlPex12p; GenBank Accession No. CAG81532
MDYFSSLNASQLDPDVPTLFELLSAKQLEGLIAPSVRYILAFYAQRHPRYLLRIVNRYDELYALFMGLVEYYNLKTWNASFTEKFYGLKRTQILTNPALRTRQAVPDLVEAEKRLSKKKIWGSLFFLIVVPYVKEKLDARYERLKGRYLARDINEERIEIKRTGTAQQIAVFEFDYWLLKLYPIVTMGCTTATLAFHMLFLFSVTRAYSIDDFLLNIQFSRMTRYDYQMETQRDSRNAANVAHTMKSISEYPVAERVMLLLTTKAGANAMRSAALSGLSYVLPTSIFALKFLEWWYASDFARQLNQKRRGDLEDNLPVPDKVKGADKLAESVAKWKEDTSKCPLCSKELVNPTVIESGYVFCYTCIYRHLEDGDEETGGRCPVTGQKLLGCRWQDDVWQVTGLRRLMV

SEQ ID NO: 119 - protein, 412 aa, Yarrowia lipolytica
  MISC_FEATURE (1)..(412): YlPex13p; GenBank Accession No. CAG81789
MSVPRPKPWEGASGSSAATATPAATATPASTDAVSSSAGSATGAPELPSRPSAMGSTSNALSSPMGSSMNSGYGGMNSGYGGMGSSYGSGYGSSYGMGSSYGSGYGSGLGGYGSYGGMGGMGGMYGSRYGGYGSYGGMGGYGGYGGMGGGPMGQNGLAGGTQATFQLIESIVGAVGGFAQMLESTYMATQSSFFAMVSVAEQFGNLKNTLGSLLGIYAIMRWARRLVAKLSGQPVTGANGITPAGFAKFEATGGAAGPGRGPRPSYKPLLFFLTAVFGLPYLLGRLIKALAAKQEGMYDEHGNLLPGAQMGMGGPGMEGGAEIDPSKLEFCRANFDFVPENPQLELELRKGDLVAVLAKTDPMGNPSQWWRVRTRDGRSGYVPANYLEVIPRPAVEAPKKVEEIGASAVPVN

SEQ ID NO: 120 - protein, 380 aa, Yarrowia lipolytica
  MISC_FEATURE (1)..(380): YlPex14p; GenBank Accession No. CAG79323
MIPSCLSTQHMAPREDLVQSAVAFLNDPQAATAPLAKRIEFLESKDMTPEEIEEALKRAGSGSAQSHPGSVVSHGGAAPTVPASYAFQSAPPLPERDWKDVFIMATVTVGVGFGLYTVAKRYLMPLILPPTPPSLEADKEALEAEFARVQGLLDQVQQDTEEVKNSQVEVAKRVTDALKGVEETIDQLKSQTKKRDDEMKLVTAEVERIRDRLPKNIDKLKDSQEQGLADIQSELKSLKQLLSTRTAASSGPKLPPIPPPSSYLTRKASPAVPAAAPAPVTPGSPVHNVSSSSTVPADRDDFIPTPAGAVPMIPQPASMSSSSTSTVPNSAISSAPSPIQEPEPFVPEPGNSAVKKPAPKASIPAWQLAALEKEKEKEKE

SEQ ID NO: 121 - protein, 391 aa, Yarrowia lipolytica
  MISC_FEATURE (1)..(391): YlPex16p; GenBank Accession No. CAG79622
MTDKLVKVMQKKKSAPQTWLDSYDKFLVRNAASIGSIESTLRTVSYVLPGRFNDVEIATETLYAVLNVLGLYHDTIIARAVAASPNAAAVYRPSPHNRYTDWFIKNRKGYKYASRAVTFVKFGELVAEMVAKKNGGEMARWKCIIGIEGIKAGLRIYMLGSTLYQPLCTTPYPDREVTGELLETICRDEGELDIEKGLMDPQWKMPRTGRTIPEIAPTNVEGYLLTKVLRSEDVDRPYNLLSRLDNWGVVAELLSILRPLIYACLLFRQHVNKTVPASTKSKFPFLNSPWAPWIIGLVIEALSRKMMGSWLLRQRQSGKTPTALDQMEVKGRTNLLGWWLFRGEFYQAYTRPLLYSIVARLEKIPGLGLFGALISDYLYLFDRYYFTASTL

SEQ ID NO: 122 - protein, 225 aa, Yarrowia lipolytica
  MISC_FEATURE (1)..(225): YlPex17p; GenBank Accession No. CAG84025
MSAFPEPSSFEIEFAKQMNRPRTVQFKQLVAVLYIFGGTSALIYIISKTILNPLFEELTFARSEYAIHARRLMEQLNAKLSSMASYIPPVRALQGQRFVDAQTQTEDEEGEDIPNPSLGKSSHVSFGESPMQLKLAEKEKQQKLIDDSVDNLERLADSLKHAGEVSDLSALSGFKYQVEELTNYSDQLAMSGYSMMKSGLPGHETAMSETKKEIRSLKGSVLSVR

SEQ ID NO: 123 - protein, 324 aa, Yarrowia lipolytica
  MISC_FEATURE (1)..(324): YlPex19p; GenBank Accession No. AAK84827
MSHEEDLDDLDDFLDEFDEQVLSKPPGAQKDATPTTSTAPTTAEAKPDATKKSTETSGTDSKTEGADTADKNAATDSAEAGAEKVSLPNLEDQLAGLKMDDFLKDIEADPESKAQFESLLKEINNVTSATASEKAQQPKSFKETISATADRLNQSNQEMGDMPLGDDMLAGLMEQLSGAGGFGEGGEGDFGDMLGGIMRQLASKEVLYQPLKEMHDNYPKWWDEHGSKVTEEKERDRLKLQQDIVGKICAKFEDPSYSDDSEADRAVITQLMDEMQETGAPPDEIMSNVADGSIPGGLDGLGLGGLGGGKMPEMPENMPECNQQ

SEQ ID NO: 124 - protein, 417 aa, Yarrowia lipolytica
  MISC_FEATURE (1)..(417): YlPex20p; GenBank Accession No. CAG79226
MASCGPSNALQNLSKHASADRSLQHDRMAPGGAPGAQRQQFRSQTQGGQLNNEFQQFAQAGPAHNSFEQSQMGPHFGQQHFGQPHQPQMGQHAPMAHGQQSDWAQSFSQLNLGPQTGPQHTQQSNWGQDFMRQSPQSHQVQPQMANGVMGSMSGMSSFGPMYSNSQLMNSTYGLQTEHQQTHKTETKSSQDAAFEAAFGAVEESITKTSDKGKEVEKDPMEQTYRYDQADALNRQAEHISDNISREEVDIKTDENGEFASIARQIASSLEEADKSKFEKSTFMNLMRRIGNHEVTLDGDKLVNKEGEDIREEVRDELLREGASQENGFQSEAQQTAPLPVHHEAPPPEQIHPHTETGDKQLEDPMVYIEQEAARRAAESGRTVEEEKLNFYSPFEYAQKLGPQGVAKQSNWEEDYDF

SEQ ID NO: 125 - protein, 195 aa, Yarrowia lipolytica
  MISC_FEATURE (1)..(195): YlPex22p; GenBank Accession No. CAG77876
VPRCTSHPCNLTLHLPVTTMAPRKTRLPAVIGAAAAAAAVAYLVYSFVAKSNSDQDTFDSSVQSSSKSSTKSPKSTATNSKITVVVSQELVQSQLVDFKHLMSVHPNLVVIVPPMVANKFHRALKSSVGHDHGVKVIRCDTDVGVIHVIKHIRPDLALIADGVGDNIQGEIKRFVGSSEALSGDVNLAAERLTGL

SEQ ID NO: 126 - protein, 386 aa, Yarrowia lipolytica
  MISC_FEATURE (1)..(386): YlPex26p; GenBank Accession No. NC_006072, antisense translation of nucleotides 117230-118387
MPPAMPQMTTSTLLTDSVTSAVNQAATPKVDQMYQTFGESAREFVNKNFYNSYELIRPFFDEITAKGAQQNGSTVLDAENPHNIPLSLWIKVWSLYLAILDASCKQAGEALLNSTGDLSGSDSGEWNQTRKLLARKLTSGSVWDELVTASGGTGNIHPTILALLASLSIRHDTDAKLMADNLEKFIVTYNDNGSDDVKTKTAFYKVLDLYLLRVLPDLGQWDVAHSFVNNTNLFSHEQKKEMTHKLDQSQKHAEQEHKRLLEEAQEKEKSDAKEKEREERVSRDTQSREIKSPIVDSSTSSRDVTRDTTRELSKSSRQPRTLSQIISTSLKSQFDGNAIFRTLALIVIVSLSAANPLIRKRVVDTLKMLWIKILQTLSMGFKVSYL

SEQ ID NO: 127 - DNA, 8739 bp, Artificial Sequence
  Plasmid pY116
ggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggtttaaacgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaagc

SEQ ID NO: 128 - DNA, 13975 bp, Artificial Sequence
  Plasmid pZKSL-5S5A5
cgatggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctctcagtcttaccacagaacagctgttagaacgccctgatttggttgcgattgatggcatcctctacgaccttgaagggcttgccaaagttcatccaggatccgatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaactctcctgcagcttcctcagcgagacactgctcctgtctggacccgagctaaggctctgttcgacaaacacgttctgcgaattggcgagtaatttcattaatgcaaatagacgtgtatttgaaaaggaggagatgatggtaccagtaatttacggtgtttgaatagacaaattatatatataaaattaacctgatgaatgagtgtatgaatggattgcttaatataccgagggagagccggcattatcaatatttattgtcctaagaagctaaaatatgctgttccgttgatagcgatgtctgtttgagagtcaatggcagaacgcggaggagtattgttagttggtgatcggtttactcgacatcgagtagggggcgagacagaagatatcccgaatccattgcattgtttattaggatgttcacaacacaactccctctagactctggggatgtgcgttagaagaatgacctggagcaagagtgttcagattgatccgttcaaattttcaagattactgttggggttgtttttgaatccacattagctggacgactattgcatctgagcgctcggaacgtctccctttcccttcagctttatacgagtcgattccataagcgcgacctctcgaattgccttcggttgtgaagccataggcaaaggtgtggctatggaatgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccgaggtttccaacgagataacatcgtggcagctgccaccatgaccgatatgcctgaaataagtgaattgaccatcagaagttctgcattcaaatagaactatatcatattcggctcagttttttcaataatagtccaatccctaagtctcctatccaaaatggttcctgaccagccacatccatgatcatgactgcgtgacaggaacagtcattccgtggatgaacgactttacgctcaggtactgtaaatatctgtaaagggcagacaaccaaccaattgagtaacctgtgagacttgaaacgtaagatgacttcacacacaaagtcacttgactcaaccgtggctctcaattgcacaaaatcactctgcactaatctattgcaggagtcaggctatgaacaactagacgacagctacttatgtgttatatagaggaatattaaaaaatctaagaataatcataaagttacaaaataattatcagatttcgagccacaggtcacccctaacatgtgttattgcacacccacaatcctcagcttgatgtcatttaattcttccagccaccatctctctctccaaccctaatggcaaactttattttggtggagcgatgactcttactcaactgcagcatacttaagcacaattgttccccagcctgatacgacacaccatccattgtcaagcttcaccacatacaacaacacagcgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcggatccgggatggaccttggcaagaccttccagatcgtagagaatgccgtcgatggcaaccaggtcgggtcgctcgagcagctgctcggtagtaagggagagagccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattggggctgttttttgggacacaaatacgccgccaacccggtctctcctgaattctgcagatgggctgcaggaattccgtcgtcgcctgagtcgactccaacttttcacactgagcgtaaaatgtggagaagaaatcggcactaaaaagtcaggtagactggaaaatgcgccatgaaatgaatatctcttgctacagtaatgcccagcatcgaggggtattgtgtcaccaacactatagtggcagctgaagcgctcgtgattgtagtatgagtctttattggtgatgggaagagttcactcaatattctcgttactgccaaaacaccacggtaatcggccagacaccatggatgtagatcaccaagcctgtgaatgttattcgagctaaaatgcacatggttggtgaaaggagtagttgctgtcgaattccgtcgtcgcctgagtcatcatttatttaccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaattcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatccccgctgatatgcctaaggaacaatcaaagaggaagatattaattcagaatgctagtatacagttagggat

SEQ ID NO: 129 - DNA, 13066 bp, Artificial Sequence
  Plasmid pZP3-Pa777U
tctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcttagttggctttggtcttggcagccttggcctccttgagggtaaacatcttggcatccttgtcgaccacgccgtacttggcgtacataagaccaattcggatgaaggtgggaatgatgggagaagccgactttcgcaccagttcgggaaaggcctgagcgaaggcagcagtggcctcgttgagcttgtagtgaggaatgatgggaaacagatggtggatctgatgtgtaccaatgttgtgggacaggttgtcgatgagggctccgtagcttcggtccacagaggacaagttgcccttgacataggtccactccgaatcggcgtaccagggagtttcctcgtcgttgtgatggaggaaggtagtgacaaccagcatggtggcgaatccaaagagaggtgcgaagtaatacagagccatggtcttgaggccgtagacgtaggtaaggtaggcgtacagaccagcaaaggccacgagagagccgagggaaatgatgacggcagacattcttcgcaggtagagaggctcccagggattgaagtggttgacctttcggggaggaaatccagcaacgaggtaggcaaaccaagccgaaccaagggagatgaccatgtgtcgggacaggggatgagagtcggcttctcgctgagggtagaagatctcatccttgtcgatgttgccggtgttcttgtgatggtgtcgatggctgatcttccacgactcgtagggagtcagaatgatggagtgaatgagtgtgccaacagagaagttgagcaggtgggatcgcgagaaggcaccatgtccacagtcgtgaccgatggtaaagaatccccagaacacgataccctggagcagaatgtagccagtgcaaaggacggcatcgagcagtgcaaactcctgcacgatagcaagggctcgagcatagtacagtccgagagcaagggaaccggcaatgcccagagctcgcacggtatagtagagggaccagggaacagaggcttcgaagcagtgggcaggcagggatcgcttgatctcggtgagagtagggaactcgtagggagcggcaacggtagaggaagccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatcgattgttgtctactaactatcgtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactaggcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactaggcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaacccta

SEQ ID NO: 130 - DNA, 4313 bp, Artificial Sequence
  Plasmid pZKUM
taatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaat

SEQ ID NO: 131 - DNA, 15991 bp, Artificial Sequence
  Plasmid pZKL2-5mB89C
gtacgttatcatttgaacagtgaaaggctacagtaacagaagcagttgtaaacttcattccgttgattctgtactacagtaccccactacgccgcttccgctgacactgttcaacccaaaaactacatctgcgtgcgctgtgtaaggctatcatcagatacatactgtagattctgtagatgcgaacctgcttgtatcatatacatccccctccccctgacctgcacaagcaagcaatgtgacattgatattgctgcttatctagtgccgaggatgtgaaagccgagactcaaacatttcttttactctcttgttcctgaccagacctggcggagattacgccagtatgattcttgcaggtctgagacaagcctggaacagccaacatttatttttcgaagcgagaaacatgccacaccccggcacgttcagagatgcatatgatttgtttttcgagtaacagtacccccccccccccccccaatgaaaccagtattactcacaccatcctcattcaaagcgttacactgattacgcgcccatcaacgacagcatgaggggactgctgatctgatctaatcaaatgactacaaaaatcgcaataatgaagagcaaacgacaaaaaagaaacaggttaaccaatcccgcttcaatgtctcaccacaatccagcactgtttctcattacctcctccctctaatttcagagttgcatcagggtccttgatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctggtttcgatttgtcttagaggaacgcatatacagtaatcatagagaataaacgatattcatttattaaagtagatagttgaggtagaagttgtaaagagtgataaatagcttagataccacagacaccctcggtgacgaagtactgcagatggtttccaatcacattgacctgctggagcagagtgttaccggcagagcactgtttattgctctggccctggcacatgacaacgttggagagaggagggtggatcaggggccagtcaataaagacctcaccagagcagtgctggtaaccgtcccagaagggcacttgagggacgatatctcctcggtgggtgattcggtagagctttcggtctttggacaccttggagacatcggggttctcctggccaaagaagagtttatcgacccagttagcaaagccagcgttaccgacaatgggctgaccaagagtaacaacgaggggatcgtggccgttaaccttgaggttgattccgaacagaagggctgcagctcctccgagagagtgaccggtgacagcaatctggtagtcgggatactgctcaatcacagagtcgagcttggggccgatctgattgtaggtgttgttgtaggactggatgaagccattgtggacaagacagtcatcacaagtagcagtagaagagatgttagcagcaagatcaaagttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcggatccgggatggaccttggcaagaccttccagatcgtagagaatgccgtcgatggcaaccaggtcgggtcgctcgagcagctgctcggtagtaagggagagagccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaatcgagcttggcgtaatcatggtcatagctgtttcctgtgtgaaattgttatccgctcacaattccacacaac

SEQ ID NO: 132 - DNA, 14554 bp, Artificial Sequence
  Plasmid pZKL1-2SR9G85
cgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggcaacgggcttgatgacagcgggaggagtgcccacattgtttcggtttcgaaagaacaggacacccttgccagctccctcggcaccagcggagggttcaacccactggcacattcgtgcagatcggtacatggctcgaatgaatcctcgaggaccgtcctggacatcagctcgatagtgcttgcccatgataggtttgatggcctcggtagcttcgtccgcattgtagaagggaatggaagagacgtagtgatgcaggacgtgagtctcgataatgccgtggagcagatgacgtccaatgaagcccatctctcggtcgatggttgcagcggcacctcgcacaaagttccactcgtcgttggtgtagtggggaagagtaggatctgtgtgctgcagaaaggtaatggcgacgagccagtggttaacccacaagtagggaacgaagtaccagatggccatgttgtagaatccgaacttctgaacgagaaagtacagagcggtggccataagaccaatgccaatgtcggagagcacgatgagcttggcgtcgctgttctcgtacagaggagatcggggatcgaaatggttaactccaccgccaagaccgttgtgctttcccttgcctcgaccctctcgctgccgctcatggtagttgtgtccagtaacgttggtaatgagatagttgggccaaccgaccagttgctgaagcacaagcatgagcagggtgaaagcaggagtttcctcggtaagatgggcgagttcgtgggtcatcttgccgagtcgagtagcttgctgctctcgggttcgaggaacgaagaccatgtctcgctccatgtttccagtggccttgtgatgcttccggtgggagatttgccagctgaagtagggaacaagcagggaagagtgaagcacccagccagtaatgtcgttgatgattcgggaatcggagaaagcaccatgtccacactcgtgggcaatgacccacagtccagtaccgaagagtccctgaagaacggtgtacacagcccacagaccggctcgagcaggagtggagggaatgtactcgggtgtcacaaagttgtaccagatgctgaaagtggtagtcaggaggacaatgtctcgaagaatgtagccgtatcccttgagagcagatcgcttgaagcagtgcttgggaatagcgttgtagatgtccttgatggtgaagtcgggaacttcgaactggttgccgtaggtatccagcatgacaccgtactcggacttgggcttggcaatgtccacctcggacatggaagacagcgatgtagaggaggccgagtgtctgggagaatcggagggagagacggcagcagactccgagtcggtcacagtggtggaagtgacggttcgtcggagggcagggttctgcttgggcagagccgaggtggaggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgaacagcatgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccattaattctcacgtgacacagattattaacgtctcgtaccaaccacagattacgacccattcgcagtcacagttcactagggtttgggttgcatccgttgagagcggtttgtttttaaccttctccatgtgctcactcaggttttgggttcagatcaaatcaaggcgtgaaccactttgtttgaggacaaatgtgacacaaccaaccagtgtcaggggcaagtccgtgacaaaggggaagatacaatgcaattactgacagttacagactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggcggaacgagcttagtcttcaattgaggtgcgagcgacacaattgggtgtcacgtggcctaattgacctcgggtcgtggagtccccagttatacagcaaccacgaggtgcatgggtaggagacgtcaccagacaatagggttttttttggactggagagggttgggcaaaagcgctcaacgggctgtttggggagctgtgggggaggaattggcgatatttgtgaggttaacggctccgatttgcgtgttttgtcgctcctgcatctccccatacccatatcttccctccccacctctttccacgataattttacggatcagcaataaggttccttctcctagtttccacgtccatatatatctatgctgcgtcgtccttttcgtgacatcaccaaaacacatacaaccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatccccgctgatatgcctaaggaacaatcaaagaggaagatattaattcagaatgctagtatacagttagggat

SEQ ID NO: 133 - DNA, 15119 bp, Artificial Sequence
  Plasmid pZSCP-Ma83
gtacgacccctctcaggccaagcagaaggctgagtccatcaagaaggccaacgctatcattgtcttcaacctcaagaacaaggctggcaagaccgagtcttggtaccttgacctcaagaacgacggtgacgtcggcaagggcaacaagtcccccaagggtgatgctgacatccagctcactctctctgacgaccacttccagcagctcgttgagggtaaggctaacgcccagcgactcttcatgaccggcaagctcaaggttaagggcaacgtcatgaaggctgccgccattgagggtatcctcaagaacgctcagaacaacctctaagcgcatcatttattgattaattgatgatttactatattgatttcgcaactgtagtgtgattgtatgtgatctggctcgtaggcttcagtaaatactagacgggtatcctacgtagttgtatcatacatcgagcctgtggttacttgtacaataattcgtaatgtagagataccccttgatccattgcctgtttctaacatacaatgatctccacgcaataatcccactcttgactaaaagttgctactcttgcacggttacctcggcatagtcacgcctctcttgtctcgtctcgaacgcacaaagtcaattgacaacgccactcactcgagtgtgccccaacagggcaccatatcgactaatttgaggccaactagggtgattttggatggaatttgatcggaaaaaatagctgcagaaattcctggagagaaaaattgaccgcatccacatggtttgaccaaaaaatcgtctccatctctgtgctcaactctcctgacgagatatgcgcgcgcacccccacatgatgtgattgatctcaacaaacttcacccagacccttatctttccgggaaacttactgtataagtggtcgtgcgaacagaaagtgtgcgcactttaggtgtctagatccgattgttctcgttctgataatgagccagccccgcgaggcaatgttttttacaattgaaaacttcgttaaccactcacattaccgtttttgccccatatttaccctctggtacactccctcttgcatacacacacactgcagtgaaaatgcactccgttagcaccgttgtgattggttcagggcacgagtttggtggtttaaggcgcaactacatcaatatgaaaacaggagacgctgaaaaggggtaatatcggactgctgctatgttgtatgtactgcatgacgaattggtgttattcaagaccgtggcacaggttgctgcggtacgagacctggtagcttctctaaacggcatgtctaggtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgtcactaatcaaggatacctaccatgccactatgatgtttgcaggaggtgtacctcggcagtcatcaaaaaatggaactactggctttagatcttgttgtatggcatcgcgcctaaaaaagaaacccccttccagcgagctactacaagtagttgtagttgcgggcgttggataccgaaagtcacaagcacatgtcgaagctctcatctgaaacaccgacagtcgtctgcaccccgcaagtctcggttcgtaccagcaccaatgttaggcagaactatacacaagagggcggacgatcacttcggcgttaggcaactgaaggctattttcggctggtactgtaggggacagaggaaacgcaagtgattagtaaatcggataataggcctgttagtttaccgaaatggtgggggaggggttccgtggatatcttgaagttatggaggctgatcgttatttgtggggatggatatcattgtatggacatactgtagctactgtataaacaacggatcttacacctgcctcttgtatgcccattgcttgatcatctatcgtgttactgtacatatacaatagatatagggaagaaaagccggaagtagagaccatagtctggcagaagtaacggcctcgggtcgagagaactataacaaagtccaacggcgggtcttagaatagccccaaggatcacacagttccgcaatccagtttcacatgttccgttgcatggacttttgcatgtctactgttgctacgattcccccattgcaaccacagtttggggttaccccgcattatattagcatgattacgaaagagataagtatcatatggaacatgtgaagggtagtatgcaggtccggcggagaaagagaatgacgttttcattaagcgattcgcttggcggcttgtgggggatgtgacgatacttacggtaaagaccctgtgtgagagctggtactcgctcgttacttcgctgatctgttgggccgtcaatcgaatctcgtggaacttgcattcttcttaactgtgtctatacaagacacctaatgaaacatacaagctaccgaaatcattttactcgtactgaccggtacggtacttgcacaagtagtgaaacttccgaaaatagccagcctcatgcatcatcgcttcaccccttctgttgacctcaaaagcattccaacggtaaaaaattataacgccgccaactggatggttgtgacggcgttgaccaccaatgtgtgggggctggcggtaggaccgagcttattcgtcccaataagctctttggatttgattctttggggtgtgtggtaaaattcacatggggaagaacacggtggcagtttgaggcagaggcccagcgtgtagttcctagggcatgaatataccgaactcatggcgcagaattgagctgaatgcgcaaaaagctacaggatcaaccgcgttagaaatgccgcaaatgtccactaattccccggactgttccaaatgattctgtggggataaatctcaaactgggttaggctttgtcacgtttctttgtgtcgtgtcggttcgtccggggcaatgtgcccacgcttggctgtctccctacacctcggtaaaaactatcacatgctgcccctctcgagcaagcattaaatgcatatagtcaatctaacgacatatatataggtagggtgcatcctccggtttagctccccagaatatctcttattcattacacaaaaacaacaatgtctctcaaggtcgacggcttcacttcttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggtctccaaccacctgttcgacgccatgcgagctgccgctcccggagacgcacctttcattcgaatcgacaacgctcggacctggacttacgatgacgccattgctctttccggtcgaatcgctggagctatggacgcactcggcattcgacccggagacagagttgccgtgcaggtcgagaagtctgccgaggcgttgattctctacctggcctgtcttcgaaccggagctgtctacctgcctctcaacactgcctacaccctggccgagctcgactacttcatcggcgatgccgaaccgcgtctggtggtcgttgctcccgcagctcgaggtggcgtggagacaattgccaagcgacacggtgctatcgtcgaaaccctcgacgccgatggacgaggctccttgctggaccttgctagagatgagcctgccgactttgtcgatgcttcgcgatctgccgacgatctggctgctattctctacacttccggtacaaccggacgatcgaagggtgccatgcttactcatggcaatctgctctccaacgctctcaccttgcgagactattggagagttaccgcagacgatcgactcatccatgccttgccaatctttcacactcatggtctgttcgttgctacgaacgtcacactgcttgcaggagcctcgatgtttctgctctccaagttcgatgccgacgaggtcgtttctctcatgccacaggccaccatgcttatgggcgtgcccacattctacgttcgattgctgcagagtcctcgactcgagaagggtgctgtggccagcatcagactgttcatttctggatcagctcccttgcttgccgaaacccacgccgagtttcatgctcgtactggtcacgccattctcgagcgatacggcatgacggaaaccaacatgaatacttccaacccctacgagggcaagcgtattgccggaaccgttggttttcctctgcccgacgtcactgtgcgagtcaccgatcccgccaccggtctcgttcttccacctgaagagactggcatgatcgagatcaagggacccaacgtcttcaagggctattggcgaatgcccgaaaagaccgctgccgagtttaccgcagacggtttctttatctctggagatctcggcaagatcgaccgagaaggttacgttcacattgtgggacgaggcaaggacctggtcatttccggtggctacaacatctatcccaaagaggtcgaaggcgagatcgaccagatcgagggtgtggtcgagtctgctgtcattggtgttcctcatcccgatttcggagaaggtgtcaccgctgttgtcgtgtgcaaacctggtgccgttctcgacgaaaagaccatcgtgtctgctctgcaggaccgtcttgcccgatacaagcaacccaagcggattatctttgccgacgatctgcctcgaaacactatgggaaaggttcagaagaacattcttcgacagcaatacgccgatctctacaccagacgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgatgtcgacgcagtaggatgtcctgcacgggtctttttgtggggtgtggagaaaggggtgcttggagatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 134 - DNA, 14623 bp, Artificial Sequence
  Plasmid pZKL4-398F2
  misc_feature (1048)..(1048): n is a, c, g, or t
  misc_feature (1053)..(1056): n is a, c, g, or t
taaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcgcctacttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccnacgannnnctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaggccttgtctgccttggcaaccattcgagcgaaggtgcccaggtaggagataagaatgccgacaccttcgagcatgggaggagatcggtagggcaggttgtgcttcttgcacagctgctccactttgatggaggcagcggtgaggttgtgtctgggaagagtaggccacaggtgatgttcgatctggtagttgaggccaccgaaaaaccagtctgtgacgaggcctcgctgaacgttcatggtctcgtgaatctgtccagcacagaagccatgaccatcccacacggagtcctgaatcttctccagagggtagtggttcatgaagacaacgatggcaattccgaagccaccaagcagctcggagacaaagaacaccatgagtccggtgagaaacgagggcatgtagaaatagtagaacaaggccttgagaccccagtggagtgccagaccgacggactccttctcgtactgtcttcgatagtactgattgcttcgatccttgagacccgtggcagtatgaatggactgaaagcaccagatgaatcgcagaagggcacagatgaaaaagaagtaatactgttggtacttgatcatccgtcgagaaaacgggccagctcgctcgacgtcctccttggaccacgccaggagaggcaggttgtcgatgtcgggatcgtgaccctgcacgttggtggcggagtgatgagcgttgtgtcggtccttccaccaagtgacagaaaagccctgaagcacgtttccgaagagcaggccaatggcattgttgatggatcggtccttgaacagctggtgatggcaaatgtcgtgcgagagccatcccatctgttgaaagtgaatgccgaggacgatagcaccaaccaggtaccagtgccactgggtcatcaacagcacggcaaggacacccagtccgagagtcgacagggtcttgtaagcgtaccacatgggagaggcatcgaacatgcctgcagcaatgagctcgtctcgcagctttcggaaatcctcctgaggttcgtcggagtttggcttgggaggtgttggagtcaggggagaggaaggttccatgatgggcattcgtctgagtttggacacggcgttctcggagtgcataaccatgaagacgtcggtagcatcccgacctcggtagttctcgataatgtcggcacctccgggatggtggttgagccaggcagaaacgtcgtaggtgacaccgtccacggtgagaggcagagcgggtcgcttgaccatggatcccatgacggccagagagtcgtagtaggtagcgggaggaagtccggcaggtcgagcgggaccggcgccctcctttttgcctcggttctttcgaggcttccgaatgtaggtctggacgtagaagttgaggaacagaagcagcaccgtgccgacataccagtagttgaagatccaggcaaacattcgcataccgtcctgccggtagcagggcacgtttcggtacttccagacgatgtagaatccgacgttgaactggataatttgcatggaggtaatgaggttcttgggcatagggaagttcagcttgatgagtcgcgtccaatagtaaccgtacatgatccagtgaatgaagccgttgagcagaacaaagatccagacgccttcgtttcgatacttgtagaacagccacatgtcgatgggagctccgagatggtgaaagaactgcagaaacgacaagggcttgtccatgaggggaaggtagaaggagtcgatgtactcgacgaacttgctgaggtagaacagctgagtggtgattcggaacacgtcattgttgaaggcagtctcacaatcgccggaaagaataccagtgacagagagagcgtaggccatcgccaggaaggagccgaacgagtagatggacatgagaaagttgtatgcggtgaacagctttttgagggtggcttgtcgcttgaggtccagaggtcgaagcatgaacttgatggccacgaaagcgaccgagaggtacagaacctcgcaagaggaggcgtcctgccagagctgggcgtagtccaccttgggaagttcctcctggacgatggagaccagctccttggcagcctccatggtaccagagctgggttagtttgtgtagagagtgtgtgttgctagcgactttcggattgtgtcattacacaaaacgcgtcgtctcgacactgatcttgtcgtggatactcacggctcggaattctgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtatcgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaatttaaatgttcctctatagtagatctgcgtacactgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaat

SEQ ID NO: 135 - DNA, 14619 bp, Artificial Sequence
  Plasmid pZP2-85m98F
cgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcacggatcccatgacggccagagagtcgtagtaggtagcgggaggaagtccggcaggtcgagcgggaccggcgccctgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtat

SEQ ID NO: 136 - DNA, 15262 bp, Artificial Sequence
  Plasmid pZK16-ML8N
gtacgcattcttgacttgctccccagttgccctttttggtcataactcagccccgactctctccccaaagaggagatggacttacaatagatacgagacaacagatattttcggccacctggtgcaattggtctgttttattacccccaataatatccacagcgtccgaatcagctcgacaagctctttctcagcatactgatcttaccccataccccccagacagcggtgccatatccatacccgcactacctgagacagtaaactcagggcaaggagcggtcttggtccatcgcgacgctgtaagctttgcctttgcgttttgtgatccaccacacggcagtcaaggtctcggttgaaagatgggtctggcaatgtggattgctgaatcattgacatataaatacgagtgatcctgccatttcccaatctttagaaatcatcttttcttcacacatacaaaaaacacacatcacaatgcagttctccgccgccgccgtccttgccctcgccgccttcgtctctgcccaggccgcctccgctgcttctgaagctggtggtgccgttgtctccggtgcctccggtgccgctgccgccgcttcttctgctgtcattggctccgagtctcaggccgcttcttctgctgcctcttctgctgctgagtctgcttcttccgctgcctctgagtccgcctcctccgcttccgcctccgagtccaaggcctctgagtccgcttccaagtccgcctccaaggcttctgagtctgcttccaaggccgagtcttctgctgccaaggcttcctccgctgctggttctgcttcttccgccgctgcctctgccaccaagtctggtgatgcctccggctcttccaagccttccggctctgcctcctctaccggtgacaagtccggtgctggtattgttgcccccgctgttggtgccatcgttgtcggtgctcttgctcagctcatctaagcggtctttgtacaactacccacttaatatttatattatgatatagactgcaatactattgcatgtgtaatgcttcgtttgaaagtcgtagtccggccattcatggcagtgtatggcagtattgcaaccaattggcttaataacatatacaaagtggcaattctgtgttcgaaccatcacacaacccaacatatttgacattgctacaagtattcgacttgttcttcggccgcacgacatgcattgctagcagcacacttgcagaagcttggccaatggttaggttgacctttaaccagtaaaacgcaatataggttgccaattaacaaacaacacagcccagaactggtgtaaagggcttgggttttgtgcaatcaactcattgactcacctcccccaatgctccatgaacccatgaatccatagtacctccatcccaattcagagaggctcagaaacacgcaattggcaaaagtaaacaaaggtctcgaaaccttaaggggtgcagtgttgcaaagttaaaattacactgttggatggtgttccactcaaactgtggatggatcagacggttgcactaaaccaagattcaatatgctctacaagtagcgtgccatgaggtgtataatatcacacatgatcagagttaaggcctggaaaaaaagtgtccgcggctatgtaacactgctgaatacagtgtgtgccgtttccacggactggaatgaatgcactcaacacgttggtagctaacttccccaactattgacttcactttactgtagctactctaagtacgataatgacatcatgaatcaccaactttatcttccccaccgaaagtaagagatgaaagagaggctaacagcttttgtaagaaaatcacaaaatctacttaccgtattacaaaagtacaagtatcagtaaccaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatgtacactgtgtgagtgtagagggcaatggtggtgacaactgagctactatacacacacagcttgtactggtataagttgtgagctacagtacaagtaatactacaaaattcagtatgtacaagtatgccggtacggcagtagcatgtatcaaagagagacagaaagaaggctggaaagcgaaggccagctgagcgtgggaaccgcagtacgtggaagtgccaaacctgcgacagaatgacatggtcttgcactttttaccggtaccggtacagtacgataccggtacgcacttgctacagtagatcatagaccaccagaataaccctgcattagcgccacgttgccaagccctcaactttctttgcagctacaccttttacaccttttaggctgccaggaagagcataaatgaattgtacttgggggcacagaatttgggttgaagtgttcctgggagagaatgtgcttggctgtatagttgggtggctctccttcatagtagatgtgaggttacagcacttgtagattgtgtacgcgttctgtttaaggtggtaccagtattatgggttgacgtgaaagaaagggaggaggcaggggtacagcaagagtgtgggcgcacactcacacatgaagcaagacctgtttcgtcatttctatttgtttaacaaggacgacataatatacttaggacagcatgggccgaccggcaggaataatctgcaaacacaatcgtattgtggcgtcccctctcgatcacgatagttgctaagtttagcagtctgagagtttggctgtgacgcaagaccgagagagagacagagagttgtcccagtttgagtactcgtaccgtactacagagtaaatcgaaatcgagcgctcactttctgcactttgtgaaggcgcagcattcaacatttgtgtccagcccctttccgtttgaagcgacttgaccacgaaatgttggaataaagctgtgttacatacgagacctacaagtagagtgtcggatatgccaactgaacaggttagatgaaagttactcaacaacaggagagcggacaccaacgtgcgaaaatgtacggatgaacccattgtctgtccgcatagcaatctgttttcgccagcagtgcttgtgtcgttggattgctgccattgtactatttgtactttgttccattaacactcgcatcttgctcaccgattagcagcactcctgttgcctcactgggcttgtctgtttcagggtggaatgcatgagcaatgcgatcgtcaaggggaggttgaaagcgcgtatggaataactgtggttctatagctgaggggaggatatcgaggacagccacggttcagtgggggatttcgggagctactcagtaacatgtactcttgtccgaacgccctgctgatggcaaatatgacaaaacgcaacaatgtggagcaacatttccatttcgagagatattacatgggttgcattggggcctgggcatcccgtgcaataaccgagaccatgtgaaggtgcacgatcgacacttatccagccagtcatacgtggtgtcgcaagctaagcaacaatgggattcacgaatctatgtgggggaacgtgcacaggggaaatgaaacaaaacggaggagggggtctttgaaaatgtagagaaatataacaaaaaatcacaaaaacgcaccaaaaatatgccaaaatcgtcaacagtggaaatcacgcgcccctggctcgacttcccactgacataccccccctcaaccaatatcatatccaccctagccaatcgcttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaaccatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggtctccaaccacctgttcgacgccatgcgagctgccgctcccggagacgcacctttcattcgaatcgacaacgctcggacctggacttacgatgacgccattgctctttccggtcgaatcgctggagctatggacgcactcggcattcgacccggagacagagttgccgtgcaggtcgagaagtctgccgaggcgttgattctctacctggcctgtcttcgaaccggagctgtctacctgcctctcaacactgcctacaccctggccgagctcgactacttcatcggcgatgccgaaccgcgtctggtggtcgttgctcccgcagctcgaggtggcgtggagacaattgccaagcgacacggtgctatcgtcgaaaccctcgacgccgatggacgaggctccttgctggaccttgctagagatgagcctgccgactttgtcgatgcttcgcgatctgccgacgatctggctgctattctctacacttccggtacaaccggacgatcgaagggtgccatgcttactcatggcaatctgctctccaacgctctcaccttgcgagactattggagagttaccgcagacgatcgactcatccatgccttgccaatctttcacactcatggtctgttcgttgctacgaacgtcacactgcttgcaggagcctcgatgtttctgctctccaagttcgatgccgacgaggtcgtttctctcatgccacaggccaccatgcttatgggcgtgcccacattctacgttcgattgctgcagagtcctcgactcgagaagggtgctgtggccagcatcagactgttcatttctggatcagctcccttgcttgccgaaacccacgccgagtttcatgctcgtactggtcacgccattctcgagcgatacggcatgacggaaaccaacatgaatacttccaacccctacgagggcaagcgtattgccggaaccgttggttttcctctgcccgacgtcactgtgcgagtcaccgatcccgccaccggtctcgttcttccacctgaagagactggcatgatcgagatcaagggacccaacgtcttcaagggctattggcgaatgcccgaaaagaccgctgccgagtttaccgcagacggtttctttatctctggagatctcggcaagatcgaccgagaaggttacgttcacattgtgggacgaggcaaggacctggtcatttccggtggctacaacatctatcccaaagaggtcgaaggcgagatcgaccagatcgagggtgtggtcgagtctgctgtcattggtgttcctcatcccgatttcggagaaggtgtcaccgctgttgtcgtgtgcaaacctggtgccgttctcgacgaaaagaccatcgtgtctgctctgcaggaccgtcttgcccgatacaagcaacccaagcggattatctttgccgacgatctgcctcgaaacactatgggaaaggttcagaagaacattcttcgacagcaatacgccgatctctacaccagacgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 137 - DNA, 13075 bp, Artificial Sequence
  Plasmid pZK16-ML
gtacgcattcttgacttgctccccagttgccctttttggtcataactcagccccgactctctccccaaagaggagatggacttacaatagatacgagacaacagatattttcggccacctggtgcaattggtctgttttattacccccaataatatccacagcgtccgaatcagctcgacaagctctttctcagcatactgatcttaccccataccccccagacagcggtgccatatccatacccgcactacctgagacagtaaactcagggcaaggagcggtcttggtccatcgcgacgctgtaagctttgcctttgcgttttgtgatccaccacacggcagtcaaggtctcggttgaaagatgggtctggcaatgtggattgctgaatcattgacatataaatacgagtgatcctgccatttcccaatctttagaaatcatcttttcttcacacatacaaaaaacacacatcacaatgcagttctccgccgccgccgtccttgccctcgccgccttcgtctctgcccaggccgcctccgctgcttctgaagctggtggtgccgttgtctccggtgcctccggtgccgctgccgccgcttcttctgctgtcattggctccgagtctcaggccgcttcttctgctgcctcttctgctgctgagtctgcttcttccgctgcctctgagtccgcctcctccgcttccgcctccgagtccaaggcctctgagtccgcttccaagtccgcctccaaggcttctgagtctgcttccaaggccgagtcttctgctgccaaggcttcctccgctgctggttctgcttcttccgccgctgcctctgccaccaagtctggtgatgcctccggctcttccaagccttccggctctgcctcctctaccggtgacaagtccggtgctggtattgttgcccccgctgttggtgccatcgttgtcggtgctcttgctcagctcatctaagcggtctttgtacaactacccacttaatatttatattatgatatagactgcaatactattgcatgtgtaatgcttcgtttgaaagtcgtagtccggccattcatggcagtgtatggcagtattgcaaccaattggcttaataacatatacaaagtggcaattctgtgttcgaaccatcacacaacccaacatatttgacattgctacaagtattcgacttgttcttcggccgcacgacatgcattgctagcagcacacttgcagaagcttggccaatggttaggttgacctttaaccagtaaaacgcaatataggttgccaattaacaaacaacacagcccagaactggtgtaaagggcttgggttttgtgcaatcaactcattgactcacctcccccaatgctccatgaacccatgaatccatagtacctccatcccaattcagagaggctcagaaacacgcaattggcaaaagtaaacaaaggtctcgaaaccttaaggggtgcagtgttgcaaagttaaaattacactgttggatggtgttccactcaaactgtggatggatcagacggttgcactaaaccaagattcaatatgctctacaagtagcgtgccatgaggtgtataatatcacacatgatcagagttaaggcctggaaaaaaagtgtccgcggctatgtaacactgctgaatacagtgtgtgccgtttccacggactggaatgaatgcactcaacacgttggtagctaacttccccaactattgacttcactttactgtagctactctaagtacgataatgacatcatgaatcaccaactttatcttccccaccgaaagtaagagatgaaagagaggctaacagcttttgtaagaaaatcacaaaatctacttaccgtattacaaaagtacaagtatcagtaaccaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatgtacactgtgtgagtgtagagggcaatggtggtgacaactgagctactatacacacacagcttgtactggtataagttgtgagctacagtacaagtaatactacaaaattcagtatgtacaagtatgccggtacggcagtagcatgtatcaaagagagacagaaagaaggctggaaagcgaaggccagctgagcgtgggaaccgcagtacgtggaagtgccaaacctgcgacagaatgacatggtcttgcactttttaccggtaccggtacagtacgataccggtacgcacttgctacagtagatcatagaccaccagaataaccctgcattagcgccacgttgccaagccctcaactttctttgcagctacaccttttacaccttttaggctgccaggaagagcataaatgaattgtacttgggggcacagaatttgggttgaagtgttcctgggagagaatgtgcttggctgtatagttgggtggctctccttcatagtagatgtgaggttacagcacttgtagattgtgtacgcgttctgtttaaggtggtaccagtattatgggttgacgtgaaagaaagggaggaggcaggggtacagcaagagtgtgggcgcacactcacacatgaagcaagacctgtttcgtcatttctatttgtttaacaaggacgacataatatacttaggacagcatgggccgaccggcaggaataatctgcaaacacaatcgtattgtggcgtcccctctcgatcacgatagttgctaagtttagcagtctgagagtttggctgtgacgcaagaccgagagagagacagagagttgtcccagtttgagtactcgtaccgtactacagagtaaatcgaaatcgagcgctcactttctgcactttgtgaaggcgcagcattcaacatttgtgtccagcccctttccgtttgaagcgacttgaccacgaaatgttggaataaagctgtgttacatacgagacctacaagtagagtgtcggatatgccaactgaacaggttagatgaaagttactcaacaacaggagagcggacaccaacgtgcgaaaatgtacggatgaacccattgtctgtccgcatagcaatctgttttcgccagcagtgcttgtgtcgttggattgctgccattgtactatttgtactttgttccattaacactcgcatcttgctcaccgattagcagcactcctgttgcctcactgggcttgtctgtttcagggtggaatgcatgagcaatgcgatcgtcaaggggaggttgaaagcgcgtatggaataactgtggttctatagctgaggggaggatatcgaggacagccacggttcagtgggggatttcgggagctactcagtaacatgtactcttgtccgaacgccctgctgatggcaaatatgacaaaacgcaacaatgtggagcaacatttccatttcgagagatattacatgggttgcattggggcctgggcatcccgtgcaataaccgagaccatgtgaaggtgcacgatcgacacttatccagccagtcatacgtggtgtcgcaagctaagcaacaatgggattcacgaatctatgtgggggaacgtgcacaggggaaatgaaacaaaacggaggagggggtctttgaaaatgtagagaaatataacaaaaaatcacaaaaacgcaccaaaaatatgccaaaatcgtcaacagtggaaatcacgcgcccctggctcgacttcccactgacataccccccctcaaccaatatcatatccaccctagccaatcgcttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaaccatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggtctccaaccacctgttcgacgccatgcgagctgccgctcccggagacgcacctttcattcgaatcgacaacgctcggacctggacttacgatgacgccattgctctttccggtcgaatcgctggagctatggacgcactcggcattcgacccggagacagagttgccgtgcaggtcgagaagtctgccgaggcgttgattctctacctggcctgtcttcgaaccggagctgtctacctgcctctcaacactgcctacaccctggccgagctcgactacttcatcggcgatgccgaaccgcgtctggtggtcgttgctcccgcagctcgaggtggcgtggagacaattgccaagcgacacggtgctatcgtcgaaaccctcgacgccgatggacgaggctccttgctggaccttgctagagatgagcctgccgactttgtcgatgcttcgcgatctgccgacgatctggctgctattctctacacttccggtacaaccggacgatcgaagggtgccatgcttactcatggcaatctgctctccaacgctctcaccttgcgagactattggagagttaccgcagacgatcgactcatccatgccttgccaatctttcacactcatggtctgttcgttgctacgaacgtcacactgcttgcaggagcctcgatgtttctgctctccaagttcgatgccgacgaggtcgtttctctcatgccacaggccaccatgcttatgggcgtgcccacattctacgttcgattgctgcagagtcctcgactcgagaagggtgctgtggccagcatcagactgttcatttctggatcagctcccttgcttgccgaaacccacgccgagtttcatgctcgtactggtcacgccattctcgagcgatacggcatgacggaaaccaacatgaatacttccaacccctacgagggcaagcgtattgccggaaccgttggttttcctctgcccgacgtcactgtgcgagtcaccgatcccgccaccggtctcgttcttccacctgaagagactggcatgatcgagatcaagggacccaacgtcttcaagggctattggcgaatgcccgaaaagaccgctgccgagtttaccgcagacggtttctttatctctggagatctcggcaagatcgaccgagaaggttacgttcacattgtgggacgaggcaaggacctggtcatttccggtggctacaacatctatcccaaagaggtcgaaggcgagatcgaccagatcgagggtgtggtcgagtctgctgtcattggtgttcctcatcccgatttcggagaaggtgtcaccgctgttgtcgtgtgcaaacctggtgccgttctcgacgaaaagaccatcgtgtctgctctgcaggaccgtcttgcccgatacaagcaacccaagcggattatctttgccgacgatctgcctcgaaacactatgggaaaggttcagaagaacattcttcgacagcaatacgccgatctctacaccagacgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaac

SEQ ID NO: 138 - DNA, 15799 bp, Artificial Sequence
  Plasmid pZKL2-5m89C
gtacgttatcatttgaacagtgaaaggctacagtaacagaagcagttgtaaacttcattccgttgattctgtactacagtaccccactacgccgcttccgctgacactgttcaacccaaaaactacatctgcgtgcgctgtgtaaggctatcatcagatacatactgtagattctgtagatgcgaacctgcttgtatcatatacatccccctccccctgacctgcacaagcaagcaatgtgacattgatattgctgcttatctagtgccgaggatgtgaaagccgagactcaaacatttcttttactctcttgttcctgaccagacctggcggagattacgccagtatgattcttgcaggtctgagacaagcctggaacagccaacatttatttttcgaagcgagaaacatgccacaccccggcacgttcagagatgcatatgatttgtttttcgagtaacagtacccccccccccccccccaatgaaaccagtattactcacaccatcctcattcaaagcgttacactgattacgcgcccatcaacgacagcatgaggggactgctgatctgatctaatcaaatgactacaaaaatcgcaataatgaagagcaaacgacaaaaaagaaacaggttaaccaatcccgcttcaatgtctcaccacaatccagcactgtttctcattacctcctccctctaatttcagagttgcatcagggtccttgatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctggtttcgatttgtcttagaggaacgcatatacagtaatcatagagaataaacgatattcatttattaaagtagatagttgaggtagaagttgtaaagagtgataaatagcttagataccacagacaccctcggtgacgaagtactgcagatggtttccaatcacattgacctgctggagcagagtgttaccggcagagcactgtttattgctctggccctggcacatgacaacgttggagagaggagggtggatcaggggccagtcaataaagacctcaccagagcagtgctggtaaccgtcccagaagggcacttgagggacgatatctcctcggtgggtgattcggtagagctttcggtctttggacaccttggagacatcggggttctcctggccaaagaagagtttatcgacccagttagcaaagccagcgttaccgacaatgggctgaccaagagtaacaacgaggggatcgtggccgttaaccttgaggttgattccgaacagaagggctgcagctcctccgagagagtgaccggtgacagcaatctggtagtcgggatactgctcaatcacagagtcgagcttggggccgatctgattgtaggtgttgttgtaggactggatgaagccattgtggacaagacagtcatcacaagtagcagtagaagagatgttagcagcaagatcaaagttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcggatccgggatggaccttggcaagaccttccagatcgtagagaatgccgtcgatggcaaccaggtcgggtcgctcgagcagctgctcggtagtaagggagagagccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgatgtcgacgcagtaggatgtcctgcacgggtctttttgtggggtgtggagaaaggggtgcttggatcgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaatcgagcttggcgtaatcatggtcatagctgtttcctgtgtgaaattgttatccgctcacaattccacacaac

SEQ ID NO: 139 - DNA, 9641 bp, Artificial Sequence
  Plasmid pY201
gtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacttcctggaggcagaagaacttgttatggaaaagctcaagagagagaagccaagatactatcaagacatgtgtcgcaacttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgatagttagtagacaacaatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtacaaccccgtggacgcagtgttgactaagattattacaaactacggaattgattcttttaccctgcgatatgccatttgtctgttgggatcttttcctcttaacgctattctgaagcggattcctgaaaagcgaatcggcctgaagtgttgttttatcatttctatgtccatgttttatctcttcggcgttctgaatctcgtgagcggatttcgaaccctcttcatttccacaatgttcacataccttatctctcggttctaccgatccaagtttatgccccatctcaacttcatgttcgtcatgggccacttggctatcaaccacattcatgctcagttcctgaacgaacaaactcaaacgaccgtcgatattacatcctcgcagatggtcctggctatgaagctgacaagctttgcctggtcttactatgacggttcgtgtacgagcgagtccgacttcaaggaccttaccgaacaccagaagtcccgagccgtccgaggccatcctccccttctgaaatttttggcttacgcctttttctactctacccttctcaccggtccctccttcgattacgctgatttcgactcttggctgaactgcgaaatgttccgggaccttcccgagtccaagaaacccatgcgaagacatcatcctggtgagcggcgtcagattcccaagaacggcaagctcgccctgtggaaggttgtccagggcctcgcctggatgattctgagcacgttgggtatgaagcacttccccgtgaagtacgtgctggacaaggacggatttcctacccgttcctttatcttccgtattcattatctgtttctgctgggattcatccaccgatttaagtattacgctgcgtggacgattagcgaaggttcgtgcattctctgtggtcttggttataatggatacgattctaagacccagaagatccggtgggatcgagtgcggaatattgatatttggacagtggagactgcacaaaacacccgagagatgctggaagcgtggaacatgaatactaacaaatggctgaagtatagcgtgtatcttagagtgactaagaagggtaagaagccaggttttcgatctaccctgtttaccttcctgacctccgccttttggcacggtacccgtcctggatactaccttaccttcgcaactggtgccctgtaccaaacctgtggaaagatctatagacgaaactttcgtcccatctttctgagagaagatggcgtgacacctctcccgtccaagaagatttacgacctggtcggcatttacgctattaagctggcctttggttacatggttcaacccttcattatccttgacctgaagccctctcttatggtttggggatccgtgtatttctacgtgcatattattgtggccttctcgttctttctgttccgaggaccatacgctaagcaggttactgaatttttcaaaagcaagcaaccgaaggagatcttcatccgaaagcagaagaagttggaaaaagacatctctgcctcttcccccaacctcggaggtattcttaaggcaaaaatcgaacatgagaagggaaagacggcagaggaggaagagatgaacttgggcattccacccatcgaactggagaagtgggacaacgccaaggaggactgggaggatttctgcaaggactacaaggagtggcggaacaagaacggactggaaattgaagaggagaacctgtccaaggccttcgagcgatttaagcaggaattttccaacgctgcgtcgggctctggtgaacgggttcggaaaatgtccttctccggatattctcctaaacccatctcgaagaaagaagaataggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaac

SEQ ID NO: 140 - DNA, 34 bp, Escherichia coli
ataacttcgtataatgtatgctatacgaagttat

SEQ ID NO: 141 - DNA, 40 bp, Artificial Sequence
  Primer 798
ctaattcacaaccatggcctttccatgggcagataagtgg

SEQ ID NO: 142 - DNA, 36 bp, Artificial Sequence
  Primer 799
ctcatgcggccgcttacttggtcttgatggtgtcct

SEQ ID NO: 143 - DNA, 40 bp, Artificial Sequence
  Primer 800
cgatagttagtagacaacaatcgatagttggagcaaggga

SEQ ID NO: 144 - DNA, 36 bp, Artificial Sequence
  Primer 801
gaaaggccatggttgtgaattagggtggtgagaatg

SEQ ID NO: 145 - DNA, 9320 bp, Artificial Sequence
  Plasmid pY168
gtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacttcctggaggcagaagaacttgttatggaaaagctcaagagagagaagccaagatactatcaagacatgtgtcgcaacttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgatagttagtagacaacaatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggcctttccctgggcagataagtgggcagccgatgcgtctgcatctacagggctgcctccggacctcctcaagattgcattcactctggtcatgtcttatccgctgagttctctcatgaaacggctgccagatgacgccaaaaacctcaagatcatctatatcatctccgtgtccatcttctacatggtgggtgtcttctccctctatggcggagctgccactctgctcttctcctcaatgggtaccttcttcatcacccaatggaagagcccttacatgccctgggtcaattttggttttgtcatgacccatctcttcgtcaatcacctgcgttcgcagtttttccccgaaacatacgaccccaatgtcattgacatcaccggagcacagatggttctgtgtatgaagctatcgtcttttggatggaacgtctacgatggatggcagattgagaagggtgagcagctcagcgagttccagactaaaagggctgttctcaagcaccccagtcttatggacttcctagcttttgtgttctacttcccttccattctgacaggtccttcttacgactatatggagttccataactggctcgatctcagcctgttcaaggagctggagaaagataaggaccccaagcgagctgctcgacgaaagcgacacaagatcccccgatctggaatcgctgcttccaagaaactcgccgctggtatcttctggatcgttctgtggacccaggtggactctcgaatctccaccgcctacgcttactcagacgcattcaccaaggagcacaacatctttggacgaattgtgtacctctacatgctcggtttcatgtaccgactcaagtactacggagcctggtccatttccgagggagcctgcatcttgtctggcctcggattccatggcgtggaccccaaaactggcaagtacaagtgggaccgtgtccagaacgtggacccgtggggattcgaaactggtcaaaacacaaaggctctgctggaggcctggaaccagaacactaacaagtggctacgaaactatgtgtacctccgagtggtgcccaaaggccaaaagcctggattccgagccactatcttcacatttgtggtttccgccttctggcatggaactcgacctggctactatctcacctttgtgaccgctgccatgtaccagtctgttggtaagttcttccgacgatacctgcgacccttcttcatggagtctgatggaaagactgccggtccctataagatctactacgacattgtgtgttggatcgttgtccaaaccgcatttggatacgctacccagtcctttatgattctagacttctggctgtcgctcaagtgttggaagaactcctggttcctgtaccacattgctctgggcgccatctttgcaatttctagcccctacaaggcatgggcgattcccaagatcaagaaaaagcaggctggagccgtcactgacaagaaggacgccaaggaggaggtgaagaaggacaccatcaagaccaagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaac

SEQ ID NO: 146 - DNA, 8726 bp, Artificial Sequence
  Plasmid pY208
gtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacttcctggaggcagaagaacttgttatggaaaagctcaagagagagaagccaagatactatcaagacatgtgtcgcaacttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgatagttagtagacaacaatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaac

SEQ ID NO: 147 - DNA, 31 bp, Artificial Sequence
  Primer 856
tcacaacacatgtccgttgcatccaagctcg

SEQ ID NO: 148 - DNA, 28 bp, Artificial Sequence
  Primer 857
tttagcggccgcctactgagtcttctgg

SEQ ID NO: 149 - DNA, 8630 bp, Artificial Sequence
  Plasmid pY207
gtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacttcctggaggcagaagaacttgttatggaaaagctcaagagagagaagccaagatactatcaagacatgtgtcgcaacttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgatagttagtagacaacaatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtccgttgcatccaagctcgtcttctacgtccgcgccgccatcgccgtggtcatctttgccgcctgtgccacctacggcgtgctggcgtccaccattctcaccgccatcggcaagcagggcctggcccaatggaccgttgccagagccttctactactcggtgcgcatcttcctgggtatcagcatcaagctgcgtagccggcaggtgaccggaaccgccggtctggatgcctccaagatccaggtcgccaacaccaccaagcccattgacgacatcaccaaacacctgccccgaccatgcattctgatttccaaccaccagaacgaaatggacattctggtgctcggtcgcatcttcccccagtactgctccgtcaccgccaaaaaggccctcaagtggtaccctctgctgggccagttcatggcgctgtccggcaccatcttcctggaccgaaaggaccgaaccaagtccgtgcagaccctcggcggcgccgtcaagaccatccagagcggcaacggaggcaagggccagagcgtcttcatgttccccgagggaacccgatcctactccaaggacgtcggcatcatgcccttcaagaagggctgtttccacctggcggtccagtcgggcgctcccattgtccccgtggtggtccagaacacctcccgaatgttttctttcggccgaggcaagctggacgccggagagatccttgtcgacgtcctgagccccattgagaccaagggtctggacgccagcaacgtcgacgctctcatggccaccacttataaggccatgtgcgagactgccgaccagattggctacgctggccagaagactcagtaggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaac

SEQ ID NO: 150 - DNA, 8630 bp, Artificial Sequence
  Plasmid pY175
gtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacttcctggaggcagaagaacttgttatggaaaagctcaagagagagaagccaagatactatcaagacatgtgtcgcaacttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgatagttagtagacaacaatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggagaacttctggtccatcgtcgtgttctttctgctctccattctgttcatcctctacaacatttcgacagtctgccactactacatgcgaatctccttctactactttaccatcctgcttcacggcatggaggtgtgcgttaccatgattccctcttggctcaacggcaagggtgccgactacgtgtttcactcgttcttctactggtgcaagtggactggagtccacaccactgtgtatggctacgagaagacccaggtcgaaggtcctgccgtggtcatctgcaaccatcagtcctcgctcgacattctgtctatggcttccatctggcccaagaactgtgttgtcatgatgaagcggattcttgcctacgttcccttcttcaacctgggagcctacttttccaacaccatcttcatcgaccgatacaaccgagagcgagctatggcttctgtcgactactgtgcctccgagatgaagaaccgaaacctgaagctctgggtgtttcccgaaggcactcggaatcgagagggtggattcattcccttcaagaaaggtgccttcaacatcgctgttcgagcccagattcccatcattcctgtcgtgttctctgactatcgagacttctactccaagcctggccgatacttcaagaacgatggagaggtcgtgatccgagtcctggatgccattcccaccaagggtctgaccctcgatgacgtctctgagctttcggacatgtgtcgagacgtcatgctggctgcctacaaggaagttaccctcgaggctcagcaacgaaacgccactcgaagaggagagaccaaggacggcaagaaatccgagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaac

SEQ ID NO: 151 - DNA, 926 bp, Saccharomyces cerevisiae
  CDS (4)..(915)
aacatgtctgttattggacgatttctttactacctgagatcggtgctcgtcgttttggccctcgctggatgtggcttctatggcgtgattgcctctatcctgtgtactctcatcggcaagcagcatctcgcgcaatggattaccgcccgatgcttttaccacgtgatgaaactgatgctgggattggacgtcaaagtcgtgggtgaagagaacctggctaagaagccctatatcatgatcgctaaccaccagtccaccctcgatatctttatgctcggcagaatcttccctcccggatgcaccgttaccgcaaagaagagccttaagtacgtccccttcctgggctggtttatggcgctttccggtacatacttcctcgaccgttccaagcggcaagaggctattgataccctgaacaaaggactggagaacgtcaaaaagaataagcgagccctctgggtttttcccgaaggtacccggtcttacacgtcggagcttaccatgctgccgttcaagaagggcgcctttcatttggcccagcagggaaagatccctatcgtcccagtggttgtgtctaacactagcacgctcgtcagccctaagtacggtgtgttcaaccgaggctgtatgattgtccgaattctgaagcccatctcgactgagaacctgacaaaagataagattggcgagttcgctgagaaagtgcgagatcagatggttgacacactgaaggaaatcggttattcccccgcaatcaacgacaccacccttcctccgcaggcaattgagtacgccgcattgcagcatgacaagaaggtgaacaaaaagattaagaacgaacctgttccatcggtgtccatttctaatgatgtgaatactcacaacgaaggatcgtctgtcaagaagatgcactaggcggccgcatg

SEQ ID NO: 152 - protein, 303 aa, Saccharomyces cerevisiae; identical to SEQ ID NO: 32

SEQ ID NO: 153 - DNA, 7891 bp, Artificial Sequence
  Plasmid pY222
tcgaccgtacgatagttagtagacaacaatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtctgttattggacgatttctttactacctgagatcggtgctcgtcgttttggccctcgctggatgtggcttctatggcgtgattgcctctatcctgtgtactctcatcggcaagcagcatctcgcgcaatggattaccgcccgatgcttttaccacgtgatgaaactgatgctgggattggacgtcaaagtcgtgggtgaagagaacctggctaagaagccctatatcatgatcgctaaccaccagtccaccctcgatatctttatgctcggcagaatcttccctcccggatgcaccgttaccgcaaagaagagccttaagtacgtccccttcctgggctggtttatggcgctttccggtacatacttcctcgaccgttccaagcggcaagaggctattgataccctgaacaaaggactggagaacgtcaaaaagaataagcgagccctctgggtttttcccgaaggtacccggtcttacacgtcggagcttaccatgctgccgttcaagaagggcgcctttcatttggcccagcagggaaagatccctatcgtcccagtggttgtgtctaacactagcacgctcgtcagccctaagtacggtgtgttcaaccgaggctgtatgattgtccgaattctgaagcccatctcgactgagaacctgacaaaagataagattggcgagttcgctgagaaagtgcgagatcagatggttgacacactgaaggaaatcggttattcccccgcaatcaacgacaccacccttcctccgcaggcaattgagtacgccgcattgcagcatgacaagaaggtgaacaaaaagattaagaacgaacctgttccatcggtgtccatttctaatgatgtgaatactcacaacgaaggatcgtctgtcaagaagatgcactaggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcg

SEQ ID NO: 154 - DNA, 32 bp, Artificial Sequence
  Primer 869
acttggcgcgccactgccgagatccagtctac

SEQ ID NO: 155 - DNA, 28 bp, Artificial Sequence
  Primer 870
tcagcctaggagcatccgttgatttccg

SEQ ID NO: 156 - DNA, 9598 bp, Artificial Sequence
  Plasmid pY177
gtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacttcctggaggcagaagaacttgttatggaaaagctcaagagagagaagccaagatactatcaagacatgtgtcgcaacttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgatagttagtagacaacaatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtccgttgcatccaagctcgtcttctacgtccgcgccgccatcgccgtggtcatctttgccgcctgtgccacctacggcgtgctggcgtccaccattctcaccgccatcggcaagcagggcctggcccaatggaccgttgccagagccttctactactcggtgcgcatcttcctgggtatcagcatcaagctgcgtagccggcaggtgaccggaaccgccggtctggatgcctccaagatccaggtcgccaacaccaccaagcccattgacgacatcaccaaacacctgccccgaccatgcattctgatttccaaccaccagaacgaaatggacattctggtgctcggtcgcatcttcccccagtactgctccgtcaccgccaaaaaggccctcaagtggtaccctctgctgggccagttcatggcgctgtccggcaccatcttcctggaccgaaaggaccgaaccaagtccgtgcagaccctcggcggcgccgtcaagaccatccagagcggcaacggaggcaagggccagagcgtcttcatgttccccgagggaacccgatcctactccaaggacgtcggcatcatgcccttcaagaagggctgtttccacctggcggtccagtcgggcgctcccattgtccccgtggtggtccagaacacctcccgaatgttttctttcggccgaggcaagctggacgccggagagatccttgtcgacgtcctgagccccattgagaccaagggtctggacgccagcaacgtcgacgctctcatggccaccacttataaggccatgtgcgagactgccgaccagattggctacgctggccagaagactcagtaggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaac

What is claimed is:

1. An extracted, unconcentrated oil comprising:
   (a) at least 50 weight percent of eicosapentaenoic acid measured as a weight percent of total fatty acids; and
   (b) a ratio of at least 3.1 of eicosapentaenoic acid, measured as a weight percent of total fatty acids, to linoleic acid, measured as a weight percent of total fatty acids.

2. The oil of claim 1, wherein said oil is a microbial oil.

3. The oil of claim 2, wherein said oil is extracted from fermented recombinant *Yarrowia* sp. cells engineered for the production of eicosapentaenoic acid, wherein said cells comprise:
   (a) at least one multizyme comprising a polypeptide having at least one delta-9 elongase linked to at least one delta-8 desaturase;
   (b) at least one peroxisome biogenesis factor protein whose expression has been down-regulated; and
   (c) at least one recombinant construct comprising a nucleotide sequence encoding an enzyme selected from the group consisting of malonyl CoA synthetase and acyl-CoA lysophospholipid acyltransferase.

4. The oil of claim 3, wherein said enzyme encoded by said nucleotide sequence is malonyl CoA synthetase.

5. The oil of claim 3, wherein said enzyme encoded by said nucleotide sequence is acyl-CoA lysophospholipid acyltransferase.

6. The oil of claim 3, wherein said delta-9 elongase and delta-8 desaturase of the multizyme are linked by a linker selected from the group consisting of: SEQ ID NO:1, SEQ ID NO:2, SEQ ID NO:3, SEQ ID NO:4, SEQ ID NO:5, SEQ ID NO:6 and SEQ ID NO:7.

7. The oil of claim 3, wherein said multizyme consists essentially of the sequence selected from the group consisting of: SEQ ID NO:9, SEQ ID NO:11 and SEQ ID NO:13.

8. The oil of claim 1, wherein said oil further comprises a fatty acid selected from the group consisting of: gamma-linolenic, eicosadienoic acid, dihomo-gamma-linolenic acid, arachidonic acid, docosatetraenoic acid, omega-6 docosapentaenoic acid, alpha-linolenic acid, stearidonic acid, eicosatrienoic acid, eicosatetraenoic acid, omega-3 docosapentaenoic acid and docosahexaenoic acid.

9. Food or feed comprising the oil of claim 8.

10. The food or feed of claim 9, wherein said food is selected from the group consisting of a food analog, a functional food, a medical food and a medical nutritional.

11. A product comprising the oil of any of claims 1-7, wherein said product is selected from the group consisting of a pharmaceutical product, an infant formula, a dietary supplement, and an animal feed.

12. The product of claim 11, which is an animal feed.

13. The product of claim 12, wherein the animal feed is an aquaculture feed.

14. The oil of claim 2, wherein said microbial oil is an oleaginous yeast oil.

15. The oil of claim 1, wherein said ratio of eicosapentaenoic acid to linoleic acid in the oil is at least 3.5.

16. The oil of claim 1, wherein said ratio of eicosapentaenoic acid to linoleic acid in the oil is at least 4.5.

17. The oil of claim 15, wherein the oil comprises at least 55 percent of eicosapentaenoic acid measured as a weight percent of total fatty acids.

18. The oil of claim 16, wherein the oil comprises at least 55 percent of eicosapentaenoic acid measured as a weight percent of total fatty acids.

19. The oil of claim 17, wherein the oil comprises at least 60 percent of eicosapentaenoic acid measured as a weight percent of total fatty acids.

20. The oil of claim 18, wherein the oil comprises at least 60 percent of eicosapentaenoic acid measured as a weight percent of total fatty acids.

21. The oil of claim 1, wherein the oil comprises at least 60 percent of eicosapentaenoic acid measured as a weight percent of total fatty acids.

22. The oil of claim 4, wherein said malonyl CoA synthetase consists essentially of a sequence selected from the group consisting of SEQ ID NO:40 and SEQ ID NO:42.

23. The oil of claim 5, wherein said acyl-CoA lysophospholipid acyltransferase consists essentially of the sequence selected from the group consisting of SEQ ID NO:15, SEQ ID NO:17, SEQ ID NO:25, SEQ ID NO:29, SEQ ID NO:31 and SEQ ID NO:32.

* * * * *